(12) United States Patent
Silverman et al.

(10) Patent No.: US 8,557,961 B2
(45) Date of Patent: Oct. 15, 2013

(54) ALPHA 1-ANTITRYPSIN COMPOSITIONS AND METHODS OF MAKING AND USING SAME

(75) Inventors: Joshua Silverman, Sunnyvale, CA (US); Volker Schellenberger, Palo Alto, CA (US); Willem P. Stemmer, Los Gatos, CA (US); Chia-Wei Wang, Milpitas, CA (US); Ian M. Brennan, Hillsborough, CA (US)

(73) Assignee: Amunix Operating Inc., Mountain View, CA (US)

( * ) Notice: Subject to any disclaimer, the term of this patent is extended or adjusted under 35 U.S.C. 154(b) by 224 days.

(21) Appl. No.: 13/078,499

(22) Filed: Apr. 1, 2011

(65) Prior Publication Data

US 2011/0288005 A1    Nov. 24, 2011

Related U.S. Application Data

(60) Provisional application No. 61/341,720, filed on Apr. 2, 2010.

(51) Int. Cl.
| | | |
|---|---|---|
| C07K 1/00 | (2006.01) | |
| C07K 14/00 | (2006.01) | |
| C07K 17/00 | (2006.01) | |
| C07K 5/00 | (2006.01) | |
| C07K 7/00 | (2006.01) | |
| C07K 16/00 | (2006.01) | |
| A61K 38/00 | (2006.01) | |

(52) U.S. Cl.
USPC ............. 530/350; 530/333; 530/344; 514/1.8

(58) Field of Classification Search
None
See application file for complete search history.

(56) References Cited

U.S. PATENT DOCUMENTS

| | | |
|---|---|---|
| 5,270,176 A | 12/1993 | Dorschug et al. |
| 5,599,907 A | 2/1997 | Anderson et al. |
| 7,442,778 B2 | 10/2008 | Gegg et al. |
| 7,452,967 B2 | 11/2008 | Bertin |
| 7,528,242 B2 | 5/2009 | Anderson et al. |
| 7,846,455 B2 | 12/2010 | Collins et al. |
| 2003/0049689 A1 | 3/2003 | Edwards et al. |
| 2003/0181381 A1 | 9/2003 | Himmelspach et al. |
| 2003/0190740 A1 | 10/2003 | Altman |
| 2004/0043446 A1 | 3/2004 | DeFrees et al. |
| 2004/0259780 A1 | 12/2004 | Glasebrook et al. |
| 2005/0042721 A1 | 2/2005 | Fang et al. |
| 2005/0118136 A1 | 6/2005 | Leung et al. |
| 2005/0123997 A1 | 6/2005 | Lollar |
| 2005/0287153 A1 | 12/2005 | Dennis |
| 2006/0026719 A1 | 2/2006 | Kieliszewski et al. |
| 2006/0287220 A1 | 12/2006 | Li et al. |
| 2006/0293232 A1 | 12/2006 | Levy et al. |
| 2007/0048282 A1 | 3/2007 | Rosen et al. |
| 2007/0161087 A1 | 7/2007 | Glaesner et al. |
| 2007/0203058 A1 | 8/2007 | Lau et al. |
| 2007/0218535 A1 | 9/2007 | Lin et al. |
| 2007/0244301 A1 | 10/2007 | Siekmann et al. |
| 2008/0039341 A1 | 2/2008 | Schellenberger et al. |
| 2008/0167238 A1 | 7/2008 | Rosen et al. |
| 2008/0176288 A1 | 7/2008 | Leung et al. |
| 2008/0286808 A1 | 11/2008 | Schellenberger et al. |
| 2008/0312157 A1 | 12/2008 | Levy et al. |
| 2009/0060862 A1 | 3/2009 | Chang et al. |
| 2009/0092582 A1 | 4/2009 | Bogin et al. |
| 2010/0189682 A1 | 7/2010 | Schellenberger et al. |
| 2010/0239554 A1 | 9/2010 | Schellenberger et al. |
| 2011/0151433 A1 | 6/2011 | Schellenberger et al. |

FOREIGN PATENT DOCUMENTS

| | | |
|---|---|---|
| WO | WO 97/33552 A1 | 9/1997 |
| WO | WO 99/49901 A1 | 10/1999 |
| WO | WO 2005/025499 A2 | 3/2005 |
| WO | WO 2005/025499 A3 | 5/2005 |
| WO | WO 2006/081249 A2 | 8/2006 |
| WO | WO 2006/081249 A3 | 2/2007 |
| WO | WO 2007/103455 A2 | 9/2007 |
| WO | WO 2007/103455 A3 | 11/2007 |
| WO | WO 2008/155134 A1 | 12/2008 |
| WO | WO 2010/091122 A1 | 8/2010 |

OTHER PUBLICATIONS

Travis et al., JBC (1985) 260:4384-4389; Casolaro, M, et al., J. Appl. Physiol. (1987) 63:2015-2023).*

Altschul et al. Basic Local Alignment Search Tool. J. Mol. Biol. 1990; 215:403-410.

Alvarez, et al. Improving Protein Pharmacokinetics by Genetic Fusion to Simple Amino Acid Sequences. J Biol Chem. 2004; 279: 3375-81.

Arndt, et al. Factors influencing the dimer to monomer transition of an antibody single-chain Fv fragment. Biochemistry. 1998; 37(37):12918-26.

Ausubel, et al. eds. Current Protocols in Molecular Biology. Wiley. 1987.

Buscaglia, et al. Tandem amino acid repeats from *Trypanosoma cruzi* shed antigens increase the half-life of proteins in blood. Blood. Mar. 15, 1999;93(6):2025-32.

(Continued)

*Primary Examiner* — Maury Audet

(74) *Attorney, Agent, or Firm* — Wilson Sonsini Goodrich & Rosati

(57) ABSTRACT

The present invention relates to compositions comprising alpha 1-antitrypsin linked to extended recombinant polypeptide (XTEN), isolated nucleic acids encoding the compositions and vectors and host cells containing the same, and methods of making and using such compositions in the treatment of alpha 1-antitrypsin-related diseases, disorders, and conditions.

6 Claims, 29 Drawing Sheets

(56) References Cited

OTHER PUBLICATIONS

Chou, et al. Prediction of Protein Conformation. Biochemistry. 1974; 13: 222-245.

Collen, et al. Polyethylene Glycol—Derivatized Cysteine-Substitution Variants of Recombinant Staphylokinase for Single-Bolus Treatment of Acute Myocardial Infarction. Circulation. 2000; 102: 1766-72.

D'Aquino, et al. The magnitude of the backbone conformational entropy change in protein folding. Proteins. 1996; 25: 143-56.

Deckert, et al. Pharmacokinetics and microdistribution of polyethylene glycol-modified humanized A33 antibody targeting colon cancer xenografts. Int J Cancer. 2000; 87: 382-90.

Dhalluin, et al. Structural and biophysical characterization of the 40 kDa PEG-interferon-alpha2a and its individual positional isomers. Bioconjug Chem. 2005; 16: 504-17.

Ellis, et al. Valid and invalid implementations of GOR secondary structure predictions. Comput Appl Biosci. Jun. 1994;10(3):341-8. (Abstract only).

Gustafsson, et al. Codon bias and heterologous protein expression. Trends Biotechnol. 2004; 22: 346-53.

Hopp, et al. Prediction of protein antigenic determinants from amino acid sequences. Proc Natl Acad Sci U S A 1981; 78, 3824, #3232.

International search report and written opinion dated Dec. 20, 2010 for PCT Application No. US10/02147.

International search report dated Jul. 12, 2011 for PCT Application No. US20/61590.

International search report dated Sep. 13, 2011 for PCT Application No. US11/31014.

International search report dated Dec. 26, 2007 for PCT Application No. US2007/05952.

International search report dated Mar. 16, 2009 for PCT Application No. US2008/09787.

International search report dated Apr. 20, 2010 for PCT Application No. US10-23106.

Kochendoerfer. Chemical and biological properties of polymer-modified proteins. Expert Opin Biol Ther. 2003; 3: 1253-61.

Kohn, et al. Random-coil behavior and the dimensions of chemically unfolded proteins. Proc Natl Acad Sci U S A. Aug. 24, 2004;101(34):12491-6.

Kornblatt, et al. Cross-linking of cytochrome oxidase subunits with difluorodinitrobenzene. Can J. Biochem. 1980; 58: 219-224.

Kubetzko, et al. Protein PEGylation decreases observed target association rates via a dual blocking mechanism. Mol Pharmacol. 2005; 68: 1439-54.

Levitt. A simplified representation of protein conformations for rapid simulation of protein folding. J Mol Biol 1976; 104, 59-107.

McPherson, et al. eds. PCR 2: a practical approach. Oxford University Press. 1995.

Mitraki, et al. Protein Folding Intermediates and Inclusion Body Formation. Bio/Technology. 1989; 7:690-697.

Oslo, ed. Remington's Pharmaceutical Sciences. 16th edition. 1980.

Pepinsky, et al. Improved pharmacokinetic properties of a polyethylene glycol-modified form of interferon-beta-1a with preserved in vitro bioactivity. J Pharmacol Exp Ther. 2001; 297: 1059-66.

Sambrook, et al. Molecular Cloning: A Laboratory Manual, 2nd Edition; Current Protocols in Molecular Biology. 1989.

Singh, et al. ProPred: Prediction of HLA-DR binding sites. Bioinformatics. 2001; 17: 1236-1237.

Smith, et al. Single-step purification of polypeptides expressed in *Escherichia coli* as fusions with glutathione S-transferase. Gene. 1988; 67(1):31-40.

Stickler, et al. Human population-based identification of CD4(+) T-cell peptide epitope determinants. J Immunol Methods. 2003; 281: 95-108.

Stites, et al. Empirical evaluation of the influence of side chains on the conformational entropy of the polypeptide backbone. Proteins. 1995; 22: 132-140.

Sturniolo, et al. Generation of tissue-specific and promiscuous HLA ligand databases using DNA microarrays and virtual HLA class II matrices. Natural Biotechnol. 1999; 17: 555-561.

Uversky, et al. Why are "natively unfolded" proteins unstructured under physiologic conditions? Proteins. Nov. 15, 2000;41(3):415-27.

Venkatachalam, et al. Conformation of polypeptide chains. Annu Rev Biochem. 1969; 38: 45-82.

Walker, et al. Using protein-based motifs to stabilize peptides. J Pept Res. Nov. 2003;62(5):214-26.

Wright, et al. Intrinsically unstructured proteins: re-assessing the protein structure-function paradigm. J Mol Biol. Oct. 22, 1999;293(2):321-31.

Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.

* cited by examiner

AG864

GASPGTSSTGSPGSSPSASTGTGPGSSPSASTGTGPGTPGSGTASSSPGSSTPSGATGSPGSSPSASTGTG
PGASPGTSSTGSPGTPGSGTASSSPGSSTPSGATGSPGTPGSGTASSSPGASPGTSSTGSPGASPGTSSTG
SPGTPGSGTASSSPGSSTPSGATGSPGASPGTSSTGS<u>PGTPGSGTASSSPGSSTPSGATGSPGSSPSASTG</u>
<u>TGPGSSPSASTGTGPGSSTPSGATGSPGSSTPSGATGSPGASPGTSSTGSPGASPGTSSTGSPGASPGTSS</u>
<u>TGSPGTPGSGTASSSPGASPGTSSTGSPGASPGTSSTGSPGASPGTSSTGSPGSSPSASTGTGPGTPGSGT</u>
<u>ASSSPGASPGTSSTGSPGASPGTSSTGSPGASPGTSSTGSPGSSTPSGATGSPGSSTPSGATGSPGASPGT</u>
<u>SSTGSPGTPGSGTASSSPGSSTPSGATGSPGSSTPSGATGSPGSSPSASTGTGPGASPG</u>
<u>TSSTGSPGASPGTSSTGSPGTPGSGTASSSPGASPGTSSTGSPGASPGTSSTGSPGASP</u>
<u>GTSSTGSPGTPGSGTASSSPGSSTPSGATGSPGTPGSGTASSSPGSSTPSGATGSPGTPGSGTASSSPGSS</u>
<u>TPSGATGSPGSSTPSGATGSPGSSPSASTGTGPGSSPSASTGTGPGASPGTSSTGSPGTPGSGTASSSPGS</u>
<u>STPSGATGSPGSSPSASTGTGPGSSPSASTGTGPGASPGTSSTGSPGASPGTSSTGSPGSSTPSGATGSPG</u>
<u>SSPSASTGTGPGASPGTSSTGSPGSSPSASTGTGPGTPGSGTASSSPGSSTPSGATGSPGSSTPSGATGSP</u>
<u>GASPGTSSTGSP</u>

↓

AG576

<u>PGTPGSGTASSSPGSSTPSGATGSPGSSPSASTGTGPGSSPSASTGTGPGSSTPSGATGSPGSSTPSGATG
SPGASPGTSSTGSPGASPGTSSTGSPGASPGTSSTGSPGTPGSGTASSSPGASPGTSSTGSPGASPGTSST
GSPGASPGTSSTGSPGSSPSASTGTGPGTPGSGTASSSPGASPGTSSTGSPGASPGTSSTGSPGASPGTSS
TGSPGSSTPSGATGSPGSSTPSGATGSPGASPGTSSTGSPGTPGSGTASSSPGSSTPSGATGSPGSSTPSG
ATGSPGSSTPSGATGSPGSSPSASTGTGPGASPGTSSTGSPGASPGTSSTGSPGTPGSGTASSSPGASPGT
SSTGSPGASPGTSSTGSPGASPGTSSTGSPGASPGTSSTGSPGTPGSGTASSSPGSSTPSGATGSPGTPGS
GTASSSPGSSTPSGATGSPGTPGSGTASSSPGSSTPSGATGSPGSSTPSGATGSPGSSPSASTGTGPGSSP
SASTGTGPGASPGTSSTGSPGTPGSGTASSSPGSSTPSGATGSPGSSPSASTGTGPGSSPSASTGTGPGAS
PGTSSTGS</u>

GASPGTSSTGSPGSSPSASTGTGPGSSPSASTGTGPGTPGSGTASSSPGSSTPSGATGSPGSSPSASTGTG
PGASPGTSSTGSPGTPGSGTASSSPGSSTPSGATGSPGTPGSGTASSSPGASPGTSSTGSPGASPGTSSTG
SPGTPGSGTASSSPGSSTPSGATGSPGASPGTSSTGSPGTPGSGTASSSPGSSTPSGATGSPGSSPSASTG
TGPGSSPSASTGTGPGSSTPSGATGSPGSSTPSGATGSPGASPGTSSTGSPGASPGTSSTGSPGASPGTSS
TGSPGTPGSGTASSSPGASPGTSSTGSPGASPGTSSTGSPGASPGTSSTGSPGSSPSASTGTGPGTPGSGT
ASSSPGASPGTSSTGSPGASPGTSSTGSPGASPGTSSTGSPGSSTPSGATGSPGSSTPSGATGSPGASPGT
SSTGSPGTPGSGTASSSPGSSTPSGATCSPGSSTPSGATGSPGSSTPSGATGSPGSSPSASTGTGPGASPG
TSSTGSPGASPGTSSTGSPGTPGSGT<u>ASSSPGASPGTSSTGSPGASPGTSSTGSPGASPGTSSTGSPGASP
GTSSTGSPGTPGSGTASSSPGSSTPSGATGSPGTPGSGTASSSPGSSTPSGATGSPGTPGSGTASSSPGSS
TPSGATGSPGSSTPSGATGSPGSSPSATASSSPGSSTPSGATGSSTGTGPGSSPSASTGTGPGASPGTSST
GSPGTPGSGTASSSPGSSTPSGATGSPGSSPSASTGTGPGSSPSASTGTGPGASPGTSSTGSPGASPGTSS
TGSPGSSTPSGATGSPGSSPSASTGTGPGASPGTSSTGSPGSSPSASTGTGPGTPGSGTASSSPGSSTPSG
ATGS</u>PGSSTPSGATGSPGASPGTSSTGSP

↓

AG288

ASSSPGASPGTSSTGSPGASPGTSSTGSPGASPGTSSTGSPGASPGTSSTGSPGTPGSGTASSSPGSST
PSGATGSPGTPGSGTASSSPGSSTPSGATGSPGTPGSGTASSSPGSSTPSGATGSPGSSTPSGATGSPG
SSPSASTGTGPGSSPSASTGTGPGASPGTSSTGSPGTPGSGTASSSPGSSTPSGATGSPGSSPSASTGT
GPGSSPSASTGTGPGASPGTSSTGSPGASPGTSSTGSPGSSTPSGATGSPGSSPSASTGTGPGASPGTS
STGSPGSSPSASTGTGPGTPGSGTASSSPGSSTPSGATGS

GASPGTSSTGS<u>PGSSPSASTGTGPGSSPSASTGTGPGTPGSGTASSSPGSSTPSGATGSPGSSPSASTGTG
PGASPGTSSTGSPGTPGSGTASSSPGSSTPSGATGSPGTPGSGTASSSPGASPGTSSTGSPGASPGTSSTG
SPGTPGSGTASSS</u>PGSSTPSGATGSPGASPGTSSTGSPGTPGSGTASSSPGSSTPSGATGSPGSSPSASTG
TGPGSSPSASTGTGPGSSTPSGATGSPGSSTPSGATGSPGASPGTSSTGSPGASPGTSSTGSPGASPGTSS
TGSPGTPGSGTASSSPGASPGTSSTGSPGASPGTSSTGSPGASPGTSSTGSPGSSPSASTGTGPGTPGSGT
ASSSPGASPGTSSTGSPGASPGTSSTGSPGASPGTSSTGSPGSSTPSGATGSPGSSTPSGATGSPGASPGT
SSTGSPGTPGSGTASSSPGSSTPSGATGSPGSSTPSGATGSPGSSTPSGATGSPGSSPSASTGTGPGASPG
TSSTGSPGASPGTSSTGSPGTPGSGTASSSPGASPGTSSTGSPGASPGTSSTGSPGASPGTSSTGSPGASP
GTSSTGSPGTPGSGTASSSPGSSTPSGATGSPGTPGSGTASSSPGSSTPSGATGSPGTPGSGTASSSPGSS
TPSGATGSPGSSTPSGATGSPGSSPSASTGTGPGSSPSASTGTGPGASPGTSSTGSPGTPGSGTASSSPGS
STPSGATGSPGSSPSASTGTGPGSSPSASTGTGPGASPGTSSTGSPGASPGTSSTGSPGSSTPSGATGSPG
SSPSASTGTGPGASPGTSSTGSPGSSPSASTGTGPGTPGSGTASSSPGSSTPSGATGSPGSSTPSGATGSP
GASPGTSSTGSP

AG144

PGSSPSASTGTGPGSSPSASTGTGPGTPGSGTASSSPGSSTPSGATGSPGSSPSASTGTGPGASPGTSS
TGSPGTPGSGTASSSPGSSTPSGATGSPGTPGSGTASSSPGASPGTSSTGSPGASPGTSSTGSPGTPGS
GTASSS

GSPAGSPTSTEEGTSESATPESGPGTSTEPSEGSAPGSPAGSPTSTEEGTSTEPSEGSAPGTSTEPSEGSA
PGTSESATPESGPGSEPATSGSETPGSEPATSGSETPGSPAGSPTSTEEGTSESATPESGPGTSTEPSEGS
APGTSTEPSEGSAPGSPAGSPTSTEEGTSTEPSEGSAPGTSTEPSEGSAPGTSESATPESGPGTSTEPSEG
SAPGTSESATPESGPGSEPATSGSETPGTSTEPSEGSAPGTSTEPSEGSAPGTSESATPESGPGTSESATP
ESGPGSPAGSPTSTEEGTSESATPESGPGSEPATSGSETPGTSESATPESGPGTSTEPSEGSAPGTSTEPS
EGSAPGTSTEPSEGSAPGTSTEPSEGSAPGTSTEPSEGSAPGTSTEPSEGSAPGSPAGSPTSTEEGTSTEP
SEGSAPGTSESATPESGPGSEPATSGSETPGTSESATPESGPGSEPATSGSETPGTSESATPESGPGTSTE
PSEGSAPGTSESATPESGPGSPAGSPTSTEEGSPAGSPTSTEEGSPAGSPTSTEEGTSESATPESGPGTST
EPSEGSAPGTSESATPESGPGSEPATSGSETPGTSESATPESGPGSEPATSGSETPGTSESATPESGPGTS
TEPSEGSAPGSPAGSPTSTEEGTSESATPESGPGSEPATSGSETPGTSESATPESGPGSPAGSPTSTEEGS
PAGSPTSTEEGTSTEPSEGSAPGTSESATPESGPGTSESATPESGPGTSESATPESGPGSEPATSGSETPG
SEPATSGSETPGSPAGSPTSTEEGTSTEPSEGSAPGTSTEPSEGSAPGSEPATSGSETPGTSESATPESGP
GTSTEPSEGSAP

↓

AE576

GSPAGSPTSTEEGTSESATPESGPGTSTEPSEGSAPGSPAGSPTSTEEGTSTEPSEGSAPGTSTEPSEG
SAPGTSESATPESGPGSEPATSGSETPGSEPATSGSETPGSPAGSPTSTEEGTSESATPESGPGTSTEP
SEGSAPGTSTEPSEGSAPGSPAGSPTSTEEGTSTEPSEGSAPGTSTEPSEGSAPGTSESATPESGPGTS
TEPSEGSAPGTSESATPESGPGSEPATSGSETPGTSTEPSEGSAPGTSTEPSEGSAPGTSESATPESGP
GTSESATPESGPGSPAGSPTSTEEGTSESATPESGPGSEPATSGSETPGTSESATPESGPGTSTEPSEG
SAPGTSTEPSEGSAPGTSTEPSEGSAPGTSTEPSEGSAPGTSTEPSEGSAPGTSTEPSEGSAPGSPAGS
PTSTEEGTSTEPSEGSAPGTSESATPESGPGSEPATSGSETPGTSESATPESGPGSEPATSGSETPGTS
ESATPESGPGTSTEPSEGSAPGTSESATPESGPGSPAGSPTSTEEGSPAGSPTSTEEGSPAGSPTSTEE
GTSESATPESGPGTSTEPSEGSAP

GSPAGSPTSTEEGTSESATPESGPGTSTEPSEGSAPGSPAGSPTSTEEGTSTEPSEGSAPGTSTEPSEGSA
PGTSESATPESGPGSEPATSGSETPGSEPATSGSETPGSPAGSPTSTEEGTSESATPESGPGTSTEPSEGS
APGTSTEPSEGSAPGSPAGSPTSTEEGTSTEPSEGSAPGTSTEPSEGSAPGTSESATPESGPGTSTEPSEG
SAPGTSESATPESGPGSEPATSGSETPGTSTEPSEGSAPGTSTEPSEGSAPGTSESATPESGPGTSESATP
ESGPGSPAGSPTSTEEGTSESATPESGPGSEPATSGSETPGTSESATPESGPGTSTEPSEGSAPGTSTEPS
EGSAPGTSTEPSEGSAPGTSTEPSEGSAPGTSTEPSEGSAPGSPAGSPTSTEEGTSTEP
SEGSAPGTSESATPESGPGSEPATSGSETPGTSESATPESGPGSEPATSGSETPGTSESATPESGPGTSTE
PSEGSAPGTSESATPESGPGSPAGSPTSTEEGSPAGSPTSTEEGSPAGSPTSTEEGTSESATPESGPGTST
EPSEGSA<u>PGTSESATPESGPGSEPATSGSETPGTSESATPESGPGSEPATSGSETPGTSESATPESGPGTS
TEPSEGSAPGSPAGSPTSTEEGTSESATPESGPGSEPATSGSETPGTSESATPESGPGSPAGSPTSTEEGS
PAGSPTSTEEGTSTEPSEGSAPGTSESATPESGPGTSESATPESGPGTSESATPESGPGSEPATSGSETPG
SEPATSGSETPGSPAGSPTSTEEGTSTEPSEGSAPGTSTEPSEGSAPGSEPATSGSETPGTSESATPESGP
GTSTEPSEGSAP</u>

AE288

GTSESATPESGPGSEPATSGSETPGTSESATPESGPGSEPATSGSETPGTSESATPESGPGTSTEPSEG
SAPGSPAGSPTSTEEGTSESATPESGPGSEPATSGSETPGTSESATPESGPGSPAGSPTSTEEGSPAGS
PTSTEEGTSTEPSEGSAPGTSESATPESGPGTSESATPESGPGTSESATPESGPGSEPATSGSETPGSE
PATSGSETPGSPAGSPTSTEEGTSTEPSEGSAPGTSTEPSEGSAPGSEPATSGSETPGTSESATPESGP
GTSTEPSEGSAP

FIG. 3E

```
LCW0569   ATGGCTNNNNNNNGCTGGCTCTCCAACCTCCACTGAGGAAGGT
          M   A   X   X   A   G   S   P   T   S   T   E   E
LCW0570   ATGGCTNNNNNNNGAAAGCGCAACCCCTGAGTCCGGTCCAGGT
          M   A   X   X   E   S   A   T   P   E   S   G   P
LCW0571   ATGGCTNNNNNNNACTCCGTCTGGTGCTACCGGTTCCCCAGGT
          M   A   X   X   T   P   S   G   A   T   G   S   P
```

> X = APST,            GS        or   GE
> TCAG/C/TCAG, AG/G/TC  or G/AG/AG
> Diversity: 16         4              4

- Batch 2 libraries are based on 3 best clones from batch 1 screening.
- All 24 codons for 6 amino acids G,E,S,P,A,T are included.
- Each new library is composed of 3x3=9 pairs of annealed oligos.

FIG. 6

1. Glucagon-Y288
2. Glucagon-Y144
3. Glucagon-Y72
4. Glucagon-Y36
- - - - = Standards

ALPHA 1-ANTITRYPSIN COMPOSITIONS AND METHODS OF MAKING AND USING SAME

CROSS-REFERENCE TO RELATED APPLICATIONS

This application claims the priority benefit of U.S. Provisional Application Ser. Nos. 61/341,720 filed Apr. 2, 2010, which is hereby incorporated herein by reference in its entirety.

STATEMENT REGARDING FEDERALLY SPONSORED RESEARCH

This invention was made with government support under SBIR grant 2R44GM079873-02 awarded by the National Institutes of Health. The government has certain rights in the invention.

SEQUENCE LISTING

The instant application contains a Sequence Listing which has been submitted in ASCII format via EFS-Web and is hereby incorporated by reference in its entirety. Said ASCII copy, created on Jul. 7, 2011, is named 32887312.txt and is 1,781,075 bytes in size.

BACKGROUND OF THE INVENTION

Alpha 1-antitrypsin (aaT) is a protease inhibitor of the serpin superfamily. It is the main protein of the alpha-globulin 1 region in gel electrophoresis of plasma, and is also referred to as alpha-1 proteinase inhibitor because it inhibits a wide variety of proteases. Physiologically, it protects tissues from the enzymes of inflammatory cells, especially neutrophil elastase, and its concentration can rise several-fold during acute inflammation. In the absence of aaT, neutrophil elastase is free to break down elastin, an important component in maintaining the elasticity of the lungs, which results in respiratory complications such as emphysema or chronic obstructive pulmonary disease (COPD).

Alpha-1 antitrypsin deficiency is an inherited disorder affecting about 1 in 1,500 to 3,500 individuals of European ancestry, but is uncommon in people of Asian descent. People with alpha-1 antitrypsin deficiency usually develop the first symptoms of lung disease between the ages of 20 and 50, which may present as shortness of breath, reduced ability to exercise, or wheezing, and propensity to respiratory infections. Persons with alpha-1 antitrypsin deficiency often develop emphysema, which can be accelerated by smoking or exposure to tobacco.

Because alpha-1 antitrypsin is expressed in the liver, certain mutations in the encoding SERPINA1 gene can cause misfolding and impaired secretion of alpha-1 antitrypsin, which can lead to liver cirrhosis. About 10 percent of children and 15 percent of adults with alpha-1 antitrypsin deficiency develop cirrhosis due to the formation of scar tissue in the liver and are also at risk for developing a type of liver cancer called hepatocellular carcinoma.

Patients with lung-forms of disease due to alpha-1 antitrypsin deficiency may receive intravenous infusions of alpha-1 antitrypsin, derived from human plasma, which must be administered once weekly. For example, the commercial product Prolastin®C is indicated for chronic augmentation and maintenance therapy in adults with emphysema due to deficiency of alpha1-antitrypsin. Prolastin®C is a plasma-derived formulation of alpha-1-anti-trypsin (a.k.a. alpha 1-antiproteinase) that, in treatment of congenital aaT deficiency, has a recommended dose regiment of 60 mg/kg once per week; a requirement of more than 200 grams of protein/patient/year. Because it is derived from plasma, the drug supply is limited, with only about 5% of the estimated 170,000 eligible patients in the United States and the European Union receiving therapy. Native glycosylation is critical for maintaining sufficient half-life of aaT, such that unmodified forms of recombinant forms of alpha-1 antitrypsin have, with their documented short half-life thus far been unsuccessful solutions to the supply and dosing schedule problems. (Travis et al., JBC (1985) 260:4384-4389; Casolaro, M, et al., J. Appl. Physiol. (1987) 63:2015-2023).

Both because the currently approved source of aaT is limited to plasma and because of the frequency of dosing required, there remains a need for a recombinant form of the protein with a longer terminal half-life that can be administered on a schedule that is at least similar or is improved compared to the plasma-derived product. Chemical modifications to a therapeutic protein can modify its in vivo clearance rate and subsequent half-life. One example of a common modification is the addition of a polyethylene glycol (PEG) moiety, typically coupled to the protein via an aldehyde or N-hydroxysuccinimide (NHS) group on the PEG reacting with an amine group (e.g. lysine side chain or the N-terminus). However, the conjugation step can result in the formation of heterogeneous product mixtures that need to be separated, leading to significant product loss and complexity of manufacturing and does not result in a completely chemically-uniform product. Also, the pharmacologic function of pharmacologically-active proteins may be hampered if amino acid side chains in the vicinity of its binding site become modified by the PEGylation process. Other approaches include the genetic fusion of an Fc domain to the therapeutic protein, which increases the size of the therapeutic protein, hence reducing the rate of clearance through the kidney. Additionally, the Fc domain confers the ability to bind to, and be recycled from lysosomes by, the FcRn receptor, which results in increased pharmacokinetic half-life. Unfortunately, the Fc domain does not fold efficiently during recombinant expression, and tends to form insoluble precipitates known as inclusion bodies. These inclusion bodies must be solubilized and functional protein must be renatured from the misfolded aggregate, a time-consuming, inefficient, and expensive process. Accordingly, there remains a need for alpha-1 antitrypsin compositions and formulations with increased half-life and retention of activity and bioavailability when administered intravenously, subcutaneously, intramuscularly, or by the pulmonary route as part of a preventive and/or therapeutic regimen for alpha-1 antitrypsin deficiency that can be administered less frequently, and are safer and less complicated and costly to produce.

SUMMARY OF THE INVENTION

The present invention is directed to compositions and methods for the treatment or prevention of a disease, disorder or condition associated with alpha 1-antitrypsin. In particular, the present invention provides compositions of fusion proteins comprising a recombinant alpha 1-antitrypsin ("aaT") and one or more extended recombinant polypeptides ("XTEN"). A subject XTEN is typically a polypeptide with a non-repetitive sequence and unstructured conformation. One or more XTEN is linked to an alpha 1-antitrypsin or sequence variants thereof, resulting in an alpha 1-antitrypsin-XTEN fusion protein ("aaT-XTEN"). In one embodiment the aaT- XTEN fusion protein of the present invention has a trypsin IC$_{50}$ value of less than about 10 μM, or about 3 μM, or about 1 μM, or about 0.30 μM, or about 0.10 μM, or about 0.03 with trypsin as the substrate. In another embodiment, the fusion protein exhibits at least about 20%, or 30%, or 40%, or 50%, or 60%, or 70%, or 80%, or at least about 90% of the trypsin inhibitory activity compared to the corresponding alpha 1-antitrypsin component not linked to the XTEN. In another embodiment, the fusion protein exhibits at least about 20%, or 30%, or 40%, or 50%, or 60%, or 70%, or 80%, or at least about 90% of the trypsin inhibitory activity compared to plasma-derived alpha 1-antitrypsin. In another embodiment, the fusion protein exhibits at least about 20%, or 30%, or 40%, or 50%, or 60%, or 70%, or 80%, or at least about 90% of the trypsin inhibitory activity compared to the corresponding alpha 1-antitrypsin component not linked to the XTEN. The present disclosure also provides pharmaceutical compositions comprising the fusion proteins and the uses thereof for treating alpha 1-antitrypsin-related diseases, disorders or conditions. The aaT-XTEN compositions have enhanced pharmacokinetic properties compared to recombinant aaT not linked to the XTEN, which permit more convenient dosing and improved efficacy. The aaT-XTEN fusion proteins of the embodiments disclosed herein exhibit one or more or any combination of the improved properties and/or the embodiments as detailed herein. In some embodiments, the aaT-XTEN compositions of the invention do not have a component selected the group consisting of: polyethylene glycol (PEG), albumin, antibody, and an antibody fragment.

In one embodiment, the invention provides an isolated alpha 1-antitrypsin fusion protein comprising an XTEN, said XTEN comprising at least 36 amino acid residues, wherein said fusion protein exhibits a terminal half-life that is longer than about 24, or longer than about 48, or longer than about 72, or longer than about 96, or longer than about 120, or longer than about 144, or longer than about 168, or longer than about 200 hours when administered to a subject. In one embodiment, the fusion protein comprises an alpha 1-antitrypsin sequence that is at least about 90%, or about 95%, or about 96%, or about 97%, or about 98%, or about 99% identical compared to an amino acid sequence selected from Table 1. In one embodiment, the aaT is human aaT. In one embodiment, a single XTEN is linked at its N-terminus or its C-terminus to the aaT. In one embodiment, the aaT-XTEN fusion protein comprises two extended recombinant polypeptides (XTEN), which can be identical or can be different, with the XTEN linked at both the N- and C-termini in which the XTEN cumulatively comprise at least 100 to about 3000 amino acid residues. The XTEN of the foregoing embodiments comprise at least 36, or at least 73, or at least 96, or at least 144, or at least 288, or at least 576, or at least 864, or at least 1000, or at least 1500, or at least 2000, or at least 2500, or at least 3000 amino acid residues. In one embodiment, the XTEN of the fusion proteins have at least 80%, or about 90%, or about 95%, or about 96%, or about 97%, or about 98% sequence identity compared to a sequence selected from Table 4 or a fragment thereof, when optimally aligned.

Non-limiting examples of fusion proteins with a single aaT linked to one or two XTEN are presented in Tables 22, and 40. In one embodiment, the invention provides a fusion protein composition has at least about 80% sequence identity compared to a sequence from Table 22 or Table 40, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared to a sequence from Table 22 or Table 40. In some embodiments, the aaT and the XTEN further comprise a spacer sequence, linking the aaT and XTEN components, wherein the spacer sequence optionally comprises a cleavage sequence that is cleavable by a protease, including endogenous mammalian proteases. Examples of such protease include, but are not limited to, FXIa, FXIIa, kallikrein, FVIIIa, FVIIIa, FXa, thrombin, elastase-2, granzyme B, MMP-12, MMP-13, MMP-17 or MMP-20, TEV, enterokinase, rhinovirus 3C protease, and sortase A, or a sequence selected from Table 6. In one embodiment, a fusion protein composition with a cleavage sequence has a sequence having at least about 80% sequence identity compared to a sequence from Table 41, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared to a sequence from Table 41. However, the invention also provides substitution of any of the aaT sequences of Table 1 for an aaT in a sequence of Table 41, and substitution of any XTEN sequence of Table 4 for an XTEN in a sequence of Table 41, and substitution of any cleavage sequence of Table 6 for a cleavage sequence in a sequence of Table 41. In embodiments having the subject cleavage sequences linked to the XTEN, cleavage of the cleavage sequence by the protease releases the XTEN from the fusion protein. In some embodiments of the fusion proteins comprising cleavage sequences that link XTEN to aaT, the aaT component becomes biologically active or has an increase in the capacity to inhibit protease activity, such as by trypsin or elastase, upon its release from the XTEN by cleavage of the cleavage sequence, wherein the resulting anti-protease activity of the cleaved protein is at least about 30%, or at least about 40%, or at least about 50%, or at least about 60%, or at least about 70%, or at least about 80%, or at least about 90% compared to the corresponding aaT not linked to XTEN. In one embodiment of the foregoing, the cleavage sequence is cleavable by elastase-2. In another embodiment, the fusion protein comprises XTEN linked to the aaT by two heterologous cleavage sequences that are cleavable by different proteases, which can be sequences of Table 6. In one embodiment of the foregoing, the cleaved aaT-XTEN has increased capacity to inhibit elastase-2.

In some embodiments of the fusion proteins disclosed herein, the XTEN is characterized in that the cumulative total of XTEN amino acid residues is greater than 36 to about 3000 amino acid residues; the sum of glycine (G), alanine (A), serine (S), threonine (T), glutamate (E) and proline (P) residues constitutes more than about 80%, or more than about 90%, or more than about 95%, or more than about 96%, or more than about 97%, or more than about 98% of the total amino acid residues of the XTEN; the sum of asparagine and glutamine residues is less than 10%, or less than 5%, or less than 2% of the total amino acid sequence of the XTEN; the sum of methionine and tryptophan residues is less than 2% of the total amino acid sequence of the XTEN; the XTEN sequence is substantially non-repetitive such that (i) the XTEN sequence contains no three contiguous amino acids that are identical unless the amino acids are serine, (ii) at least about 80%, or at least about 90%, or at least about 95%, or at least about 96%, or at least about 97%, or at least about 98% of the XTEN sequence consists of non-overlapping sequence motifs, each of the sequence motifs comprising about 9 to about 14 amino acid residues, wherein any two contiguous amino acid residues do not occur more than twice in each of the sequence motifs; or (iii) the XTEN sequence has a subsequence score of less than 10, or less than 9, or less than 8, or less than 7, or less than 6, or less than 5; the XTEN sequence has greater than 90%, or greater than 95%, or greater than 96%, or greater than 97%, or greater than 98% random coil formation as determined by GOR algorithm; the XTEN sequence has less than 2% alpha helices and 2% beta-sheets as determined by Chou-Fasman algorithm; and the XTEN sequence lacks a predicted T-cell epitope when analyzed by TEPITOPE algorithm, wherein the TEPITOPE algorithm prediction for epitopes within the XTEN sequence is based on a score of −9. In one embodiment of the foregoing, the fusion protein exhibits an apparent molecular weight factor of at least about 3, or at least about 4, or at least about 5, or at least about 6, or at least about 7, or at least about 8. In some embodiments, no one type of amino acid selected from glycine (G), alanine (A), serine (S), threonine (T), glutamate (E) and proline (P) constitutes more than about 8%, or about 16%, or about 20%, or about 25%, or about 30% of the XTEN sequence.

In one embodiment of the aaT-XTEN composition, the invention provides a fusion protein of formula I:

(aaT)-(XTEN)    I wherein independently for each occurrence, aaT is a alpha 1-antitrypsin as defined herein and XTEN is an extended recombinant polypeptide as defined herein.

In another embodiment of the aaT-XTEN composition, the invention provides a fusion protein of formula II:

(XTEN)-(aaT)    II wherein independently for each occurrence, aaT is a alpha 1-antitrypsin as defined herein and XTEN is an extended recombinant polypeptide as defined herein.

In another embodiment of the aaT-XTEN composition, the invention provides an isolated fusion protein, wherein the fusion protein is of formula III:

(XTEN)-(aaT)-(XTEN)    III wherein independently for each occurrence, aaT is a alpha 1-antitrypsin as defined herein and XTEN is an extended recombinant polypeptide as defined herein.

In another embodiment of the aaT-XTEN composition, the invention provides an isolated fusion protein, wherein the fusion protein is of formula IV:

(aaT)-(XTEN)-(aaT)    IV wherein independently for each occurrence, aaT is a alpha 1-antitrypsin as defined herein and XTEN is an extended recombinant polypeptide as defined herein.

In another embodiment of the aaT-XTEN composition, the invention provides an isolated fusion protein, wherein the fusion protein is of formula V:

$(XTEN)_x$-$(S)_x$-$(aaT)$-$(S)_y$-$(XTEN)_y$    V wherein independently for each occurrence, aaT is a alpha 1-antitrypsin as defined herein; S is a spacer sequence having between 1 to about 50 amino acid residues that can optionally include a cleavage sequence or amino acids compatible with restrictions sites; x is either 0 or 1 and y is either 0 or 1 wherein x+y>1; and XTEN is an extended recombinant polypeptide as defined herein. In the embodiments of formula V, the spacer sequence optionally comprises a cleavage sequence that is cleavable by a mammalian protease selected from the group consisting of factor XIa, factor XIIa, kallikrein, factor VIIa, factor IXa, factor Xa, factor IIa (thrombin), elastase-2, MMP-12, MMP13, MMP-17 and MMP-20.

In some embodiments, administration of a therapeutically effective dose of a fusion protein of one of formulae I-V to a subject in need thereof can result in a gain in time of at least two-fold, or at least three-fold, or at least four-fold, or at least five-fold or more spent within a therapeutic window for the fusion protein compared to the corresponding aaT not linked to the XTEN and administered at a comparable dose to a subject. In other cases, administration of a therapeutically effective dose of a fusion protein of an embodiment of formulae I-V to a subject in need thereof can result in a gain in time between consecutive doses necessary to maintain a therapeutically effective dose regimen of at least 48 h, or at least 72 h, or at least about 96 h, or at least about 120 h, or at least about 7 days, or at least about 14 days, or at least about 21 days between consecutive doses compared to an aaT not linked to XTEN and administered at a comparable dose.

The fusion protein compositions of the embodiments described herein can be evaluated for retention of activity (including after cleavage of any incorporated XTEN-releasing cleavage sites) using any appropriate in vitro assay disclosed herein (e.g., the assays of Table 39 or the assays described in the Examples), to determine the suitability of the configuration for use as a therapeutic agent in the treatment of an aaT-factor related disease, disorder or condition. In one embodiment, the fusion protein exhibits at least about 50%, or at least about 60%, or at least about 70%, or at least about 80%, or at least about 90% of the activity compared to the corresponding aaT not linked to XTEN. In another embodiment, the aaT component released from the fusion protein by enzymatic cleavage of the incorporated cleavage sequence linking the aaT and XTEN components exhibits at least about 50%, or at least about 60%, or at least about 70%, or at least about 80%, or at least about 90% of the activity compared to the corresponding aaT not linked to XTEN.

In another embodiment, the invention provides fusion proteins comprising aaT and one or more XTEN, wherein the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein each of the sequence motifs has about 9 to about 14 amino acid residues and wherein the sequence of any two contiguous amino acid residues does not occur more than twice in each of the sequence motifs consisting of four to six types of amino acids selected from glycine (G), alanine (A), serine (S), threonine (T), glutamate (E) and proline (P). In one embodiment, the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein the motifs are selected from Table 3.

In one embodiment, the aaT-XTEN fusion proteins have an XTEN sequence in which no three contiguous amino acids are identical unless the amino acid is serine, in which case no more than three contiguous amino acids are serine residues. In another embodiment, the XTEN components of the aaT-XTEN fusion proteins, either singly or cumulatively, have a subsequence score of less than 10, or less than 9, or less than 8, or less than 7, or less than 6, or less than 5. In the embodiments of this paragraph, the XTEN are characterized as "substantially non-repetitive."

In some embodiments, fusion proteins comprising aaT and one or more XTEN exhibit enhanced pharmacokinetic properties compared to aaT not linked to the XTEN, wherein the enhanced properties include but are not limited to longer terminal half-life, larger area under the curve, increased time in which the blood concentration remains within the therapeutic window, increased time between consecutive doses results in blood concentrations within the therapeutic window, and decreased dose over time that can be administered compared to an aaT not linked to the XTEN, yet still result in a blood concentration within the therapeutic window. In some embodiments, the terminal half-life of the fusion protein administered to a subject is increased at least about three-fold, or at least about four-fold, or at least about five-fold, or at least about six-fold, or at least about eight-fold, or at least about ten-fold, or at least about 20-fold, or at least about 40-fold, or at least about 60-fold, or at least about 100-fold, or even higher as compared to the corresponding recombinant aaT not linked to the XTEN and administered to a subject at a comparable dose. In other embodiments, the terminal half-life of the fusion protein administered to a subject is at least about 12 h, or at least about 24 h, or at least about 48 h, or at least about 72 h, or at least about 96 h, or at least about 120 h, or at least about 144 h, or at least about 21 days or greater. In other embodiments, the enhanced pharmacokinetic property is reflected by the fact that the blood concentrations that remain within the therapeutic window for the fusion protein for a given period are at least about two-fold, or at least about three-fold, or at least about four-fold, or at least about five-fold, or at least about six-fold, or at least about eight-fold, or at least about ten-fold longer, or at least about 20-fold, or at least about 40-fold, or at least about 60-fold, or at least about 100-fold compared to the corresponding aaT not linked to the XTEN and administered to a subject at a comparable dose. The increase in half-life and time spent within the therapeutic window permits less frequent dosing and decreased amounts of the fusion protein (in moles equivalent) that are administered to a subject, compared to the corresponding aaT not linked to the XTEN. In one embodiment, administration of three or more doses of a subject fusion protein to a subject using a therapeutically-effective dose regimen results in a gain in time of at least two-fold, or at least three-fold, or at least four-fold, or at least five-fold, or at least six-fold, or at least eight-fold, or at least 10-fold, or at least about 20-fold, or at least about 40-fold, or at least about 60-fold, or at least about 100-fold or higher between at least two consecutive $C_{max}$ peaks and/or $C_{min}$ troughs for blood levels of the fusion protein compared to the corresponding aaT not linked to the XTEN and administered using a comparable dose regimen to a subject.

In some embodiments, the fusion protein is characterized in that: (i) it has a longer half-life when administered to a subject compared to the corresponding aaT not linked to the XTEN administered to a subject under an otherwise equivalent dose; (ii) when a smaller amount of moles of the fusion protein is administered to a subject in comparison to the corresponding aaT that lacks the XTEN administered to a subject under an otherwise equivalent dose regimen, the fusion protein achieves a comparable area under the curve (AUC) as the corresponding aaT not linked to the XTEN; (iii) when a smaller amount of moles of the fusion protein is administered to a subject in comparison to the corresponding aaT that lacks the XTEN administered to a subject under an otherwise equivalent dose regimen, the fusion protein achieves a comparable therapeutic effect as the corresponding aaT not linked to the XTEN; (iv) when the fusion protein is administered to a subject less frequently in comparison to the corresponding aaT not linked to the XTEN administered to a subject using an otherwise equivalent amount, the fusion protein achieves a comparable area under the curve (AUC) as the corresponding aaT not linked to the XTEN; (v) when the fusion protein is administered to a subject less frequently in comparison to the corresponding aaT not linked to the XTEN administered to a subject using an otherwise equivalent amount of moles of protein, the fusion protein achieves a comparable therapeutic effect as the corresponding aaT not linked to the XTEN; (vi) when an accumulatively smaller amount of moles of the fusion protein is administered to a subject in comparison to the corresponding aaT not linked to the XTEN administered to a subject under an otherwise equivalent dose period, the fusion protein achieves comparable area under the curve (AUC) as the corresponding aaT not linked to the XTEN; or (vii) when an accumulatively smaller amount of moles of the fusion protein is administered to a subject in comparison to the corresponding aaT not linked to the XTEN administered to a subject under an otherwise equivalent dose period, the fusion protein achieves comparable therapeutic effect as the corresponding aaT not linked to the XTEN.

In some embodiments, the XTEN enhances thermostability of aaT when linked to the XTEN wherein the thermostability is ascertained by measuring the retention of biological activity after exposure to a temperature of about 37° C. for at least about 7 days of the biologically active protein in comparison to the biologically active protein not linked to the XTEN. In one embodiment of the foregoing, the retention of biological activity increases by at least about 50%, at least about 60%, at least about 70%, at least about 80%, at least about 90%, at least about 100%, or about 150%, at least about 200%, at least about 300%, or about 500% longer compared to the aaT not linked to the XTEN.

In some embodiments, the isolated fusion protein comprising aaT and one or more XTEN is configured to have reduced binding affinity for a clearance receptor as compared to the corresponding aaT not linked to the XTEN. In one embodiment, the aaT-XTEN fusion protein exhibits binding affinity for a clearance receptor of the aaT in the range of about 0.01%-30%, or about 0.1% to about 20%, or about 1% to about 15%, or about 2% to about 10% of the binding affinity of the corresponding aaT not linked to the XTEN. In another embodiment, a fusion protein with reduced affinity can have reduced active clearance and a corresponding increase in half-life of at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold longer compared to the corresponding aaT that is not linked to the XTEN.

In some embodiments, the invention provides fusion proteins comprising aaT and one or more XTEN wherein the fusion protein exhibits increased solubility of at least three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least 40-fold, or at least 60-fold at physiologic conditions compared to the corresponding aaT not linked to XTEN.

In some embodiments, the fusion proteins exhibit an increased apparent molecular weight as determined by size exclusion chromatography, compared to the actual molecular weight. In some embodiments the fusion protein comprising an aaT and at least a first XTEN exhibits an apparent molecular weight of at least about 200 kDa, or at least about 400 kDa, or at least about 500 kDa, or at least about 700 kDa, or at least about 1000 kDa, or at least about 1400 kDa, or at least about 1600 kDa, or at least about 1800 kDa, or at least about 2000 kDa, or at least about 3000 kDa, while the actual molecular weight of the aaT component of the fusion protein is about 44 kDa in the case of an aaT mature form and the actual molecular weight of the fusion protein for an aaT plus a single XTEN ranges from about 71 to about 270 kDa, depending on the length of the XTEN. Accordingly, the fusion proteins can have an apparent molecular weight that is about 1.3-fold greater, or about 2-fold greater, or about 3-fold greater or about 4-fold greater, or about 8-fold greater, or about 10-fold greater, or about 12-fold greater, or about 15-fold greater than the actual molecular weight of the fusion protein. In some cases, the isolated fusion protein of any of the embodiments disclosed herein exhibit an apparent molecular weight factor under physiologic conditions that is greater than about 1.3, or about 2, or about 3, or about 4, or about 5, or about 6, or about 7, or about 8, or about 10, or greater than about 15.

The invention provides a method of producing a fusion protein comprising a alpha 1-antitrypsin fused to one or more extended recombinant polypeptides (XTEN), comprising: (a) providing a host cell comprising a recombinant polynucleotide molecule encoding the fusion protein (b) culturing the host cell under conditions permitting the expression of the fusion protein; and (c) recovering the fusion protein from the culture. In one embodiment of the method, the expressed alpha 1-antitrypsin of the fusion protein has at least 90%, or about 91%, or about 92%, or about 93%, or about 94%, or about 95%, or about 96%, or about 97%, or about 98%, or about 99% sequence identity compared to a sequence selected from Table 1. In another embodiment of the method, the one or more XTEN of the expressed fusion protein has at least about 90%, or about 91%, or about 92%, or about 93%, or about 94%, or about 95%, or about 96%, or about 97%, or about 98%, or about 99% to about 100% sequence identity compared to a sequence selected from Table 4, Table 8, Table 9, Table 10, Table 11, Table 12, Table 13, Table 14, Table 17 and Table 18. In another embodiment of the method, the host cell is a prokaryotic cell. In another embodiment of the method, the host cell is *E. coli*. In another embodiment of the method the isolated fusion protein is recovered from the host cell cytoplasm in substantially soluble form.

The invention provides isolated nucleic acids comprising a polynucleotide sequence selected from (a) a polynucleotide encoding the fusion protein of any of the foregoing embodiments, or (b) the complement of the polynucleotide of (a). In one embodiment, the invention provides an isolated nucleic acid comprising a polynucleotide sequence that has at least 80% sequence identity, or about 85%, or at least about 90%, or about 91%, or about 92%, or about 93%, or about 94%, or about 95%, or about 96%, or about 97%, or about 98%, or about 99% to about 100% sequence identity compared to (a) a polynucleotide sequence encoding a polypeptide of any one of Table 22, 35 or 40; or (b) the complement of the polynucleotide of (a). The invention provides expression vectors comprising the nucleic acid of any one of the embodiments hereinabove described in this paragraph. In one embodiment, the expression vector of the foregoing further comprises a recombinant regulatory sequence operably linked to the polynucleotide sequence. In another embodiment, the polynucleotide sequence of the expression vectors of the foregoing is fused in frame to a polynucleotide encoding a secretion signal sequence, which can be an aaT native signal sequence. The invention provides a host cell that comprises an expression vector of any of the embodiments hereinabove described in this paragraph. In one embodiment, the host cell is a prokaryotic cell. In another embodiment, the host cell is *E. coli*. In another embodiment, the host cell is a yeast.

The invention provides a method of treating an alpha 1-antitrypsin-related disease, disorder or condition in a subject, comprising administering to the subject a therapeutically effective amount of a fusion protein of any of the foregoing embodiments. In one embodiment of the method, the alpha 1-antitrypsin-related condition is selected from genetic alpha 1-antitrypsin deficiency, emphysema, chronic obstructive pulmonary disease (COPD), bronchiectasis, parenchymatic and fibrotic lung diseases or disorders, cystic fibrosis, interstitial pulmonary fibrosis, lung sarcoidosis, liver cirrhosis, liver failure, tuberculosis and lung diseases and disorders secondary to HIV. In one embodiment of the method of treatment, the fusion protein comprises an alpha 1-antitrypsin fused to at least a first XTEN, wherein the alpha 1-antitrypsin sequence has at least 80%, or about 85%, or at least about 90%, or about 91%, or about 92%, or about 93%, or about 94%, or about 95%, or about 96%, or about 97%, or about 98% sequence identity compared to a sequence selected from Table 1, wherein the XTEN is characterized in that the cumulative total of XTEN amino acid residues is greater than 36 to about 3000 amino acid residues; the sum of glycine (G), alanine (A), serine (S), threonine (T), glutamate (E) and proline (P) residues constitutes more than about 80%, or about 85%, or at least about 90%, or about 91%, or about 92%, or about 93%, or about 94%, or about 95%, or about 96%, or about 97%, or about 98% of the total amino acid residues of each of the XTEN; the sum of asparagine and glutamine residues is less than 10% of the total amino acid sequence of each of the XTEN; the sum of methionine and tryptophan residues is less than 2% of the total amino acid sequence of each of the XTEN; each of the XTEN sequence is substantially non-repetitive such that (i) the XTEN sequence contains no three contiguous amino acids that are identical unless the amino acids are serine, (ii) at least about 80% of the XTEN sequence consists of non-overlapping sequence motifs, each of the sequence motifs comprising about 9 to about 14 amino acid residues, wherein any tow contiguous amino acid residues does not occur more than twice in each of the sequence motifs; or (iii) the XTEN sequence has a subsequence score of less than 10, or less than 9, or less than 8, or less than 7, or less than 6, or less than 5; each of the XTEN sequences has greater than 90% random coil formation as determined by GOR algorithm; each of the XTEN sequence has less than 2% alpha helices and 2% beta-sheets as determined by Chou-Fasman algorithm; and each of the XTEN sequence lacks a predicted T-cell epitope when analyzed by TEPITOPE algorithm, wherein the TEPITOPE algorithm prediction for epitopes within the XTEN sequence is based on a score of −9.

In some embodiments of the method of treatment, (i) a smaller amount of moles (e.g. of about two-fold less, or about three-fold less, or about four-fold less, or about five-fold less, or about six-fold less, or about eight-fold less, or about 100 fold-less or greater) of the fusion protein is administered in comparison to the corresponding aaT not linked to the XTEN under an otherwise same dose regimen, and the fusion protein achieves a comparable area under the curve and/or a comparable therapeutic effect as the corresponding aaT not linked to the XTEN; (ii) the fusion protein is administered less frequently (e.g., every two days, about every seven days, about every 14 days, about every 21 days, or about, monthly) in comparison to the corresponding alpha 1-antitrypsin not linked to the XTEN under an otherwise same dose amount, and the fusion protein achieves a comparable area under the curve and/or a comparable therapeutic effect as the corresponding alpha 1-antitrypsin not linked to the XTEN; or (iii) an accumulative smaller amount of moles (e.g. about 5%, or about 10%, or about 20%, or about 40%, or about 50%, or about 60%, or about 70%, or about 80%, or about 90% less) of the fusion protein is administered in comparison to the corresponding aaT not linked to the XTEN under the otherwise same dose regimen the fusion protein achieves a comparable area under the curve and/or a comparable therapeutic effect as the corresponding aaT not linked to the XTEN. The accumulative smaller amount is measured for a period of at least about one week, or about 14 days, or about 21 days, or about one month. The therapeutic effect can be a measured parameter selected from blood concentrations of aaT, enzyme inhibition assays of body fluids, pulmonary function tests, among others.

In another embodiment, the present invention provides a method of treating a disease, disorder or condition, comprising administering the pharmaceutical composition described above to a subject using multiple consecutive doses of the pharmaceutical composition administered using a therapeutically effective dose regimen. In one embodiment of the foregoing, the therapeutically effective dose regimen can result in a gain in time of at least three-fold, or alternatively, at least four-fold, or five-fold, or six-fold, or seven-fold, or eight-fold, or nine-fold, or at least 10-fold, or at least 20-fold longer time between at least two consecutive $C_{max}$ peaks and/or $C_{min}$ troughs for blood levels of the fusion protein compared to the corresponding aaT of the fusion protein not linked to the fusion protein and administered at a comparable dose regimen to a subject. In another embodiment of the foregoing, the administration of the fusion protein results in improvement in at least one measured parameter of an alpha 1-antitrypsin-related disease using less frequent dosing or a lower total dosage of the fusion protein of the pharmaceutical composition compared to the corresponding biologically active protein component(s) not linked to the fusion protein and administered to a subject using a therapeutically effective regimen to a subject.

In one embodiment, the invention provides pharmaceutical compositions comprising the fusion protein of any of the foregoing embodiments and a pharmaceutically acceptable carrier. In another embodiment, the invention provides kits, comprising packaging material and at least a first container comprising the pharmaceutical composition of the foregoing embodiment and a sheet of instructions for the reconstitution and/or administration of the pharmaceutical compositions to a subject. The pharmaceutical composition can be administered by any suitable means, including parenterally, subcutaneously, intramuscularly, intravenously, or by inhalation. In one embodiment of the pharmaceutical composition for subcutaneous, intramuscular or intradermal administration, the composition is capable of increasing alpha 1-antitrypsin activity to at least 10% of the normal plasma level in the blood for at least 12, or about 24, or about 48, or about 72, or about 144 hours after subcutaneous, intramuscular or intradermal administration of a therapeutically effective amount of the fusion protein. In another embodiment, the pharmaceutical composition for subcutaneous, intramuscular or intradermal administration is capable of providing alpha 1-antitrypsin activity of at least 20% of the normal plasma level for lest 12, or about 24, or about 48, or about 72, or about 144 hours after subcutaneous, intramuscular or intradermal administration of a therapeutically effective amount of the fusion protein.

In one embodiment, wherein the pharmaceutical composition is administered at a therapeutically effective amount, the administration results in a gain in time spent above a 8 µM blood concentration of at least two-fold longer than the corresponding aaT not linked to the XTEN, or alternatively, at least three-fold, at least four-fold, or five-fold, or six-fold, or seven-fold, or eight-fold, or nine-fold, or at least 10-fold, or at least 20-fold longer than the corresponding aaT not linked to XTEN and administered at a comparable dose to a subject. In another embodiment, wherein the pharmaceutical composition is administered at a therapeutically effective amount, the administration results in a blood concentration above a 8 µM for at least about 24 hr, or at least about 48 h, or at least about 72 h, or at least about 96 h, or at least about 120 h.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 3 illustrates the use of donor XTEN sequences to produce truncated XTEN sequences. FIG. 3A provides the sequence of AG864 (SEQ ID NO: 74), with the underlined sequence used to generate an AG576 (SEQ ID NO: 69) sequence. FIG. 3B provides the sequence of AG864 (SEQ ID NO: 820), with the underlined sequence used to generate an AG288 (SEQ ID NO: 61) sequence. FIG. 3C provides the sequence of AG864 (SEQ ID NO: 74), with the underlined sequence used to generate an AG144 (SEQ ID NO: 56) sequence. FIG. 3D provides the sequence of AE864 (SEQ ID NO: 72), with the underlined sequence used to generate an AE576 (SEQ ID NO: 67) sequence. FIG. 3E provides the sequence of AE864 (SEQ ID NO: 72), with the underlined sequence used to generate an AE288 (SEQ ID NO: 60) sequence.

FIG. 6 shows three randomized libraries used for the third and fourth codons in the N-terminal sequences of clones from LCW546, LCW547 and LCW552. The libraries were designed with the third and fourth residues modified such that all combinations of allowable XTEN codons were present at these positions, as shown. In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of the three libraries LCW0569 (SEQ ID NOS 821-822, respectively, in order of appearance), LCW0570 (SEQ ID NOS 823-824, respectively, in order of appearance), and LCW0571 (SEQ ID NOS 825-826, respectively, in order of appearance).

FIG. 12A shows two different configurations of aaT-XTEN fusion proteins (100), each comprising a single aaT and an XTEN, the first of which has an XTEN molecule (102) attached to the C-terminus of an aaT (103), and the second of which has an XTEN molecule attached to the N-terminus of an aaT (103). FIG. 12B shows two different configurations of aaT-XTEN fusion proteins (100), each comprising a single aaT, a spacer sequence and an XTEN, the first of which has an XTEN molecule (102) attached to the C-terminus of a spacer sequence (104) and the spacer sequence attached to the C-terminus of an aaT (103) and the second of which has an XTEN molecule attached to the N-terminus of a spacer sequence (104) and the spacer sequence attached to the N-terminus of an aaT (103). FIG. 12C shows two different configurations of aaT-XTEN fusion proteins (101), each comprising two molecules of a single aaT and one molecule of an XTEN, the first of which has an XTEN linked to the C-terminus of a first aaT and that aaT is linked to the C-terminus of a second aaT, and the second of which is in the opposite orientation in which the XTEN is linked to the N-terminus of a first aaT and that aaT is linked to the N-terminus of a second aaT. FIG. 12D shows two different configurations of aaT-XTEN fusion proteins (101), each comprising two molecules of a single aaT, a spacer sequence and one molecule of an XTEN, the first of which has an XTEN linked to the C-terminus of a spacer sequence and the spacer sequence linked to the C-terminus of a first aaT which is linked to the C-terminus of a second aaT, and the second of which is in the opposite orientation in which the XTEN is linked to the N-terminus of a spacer sequence and the spacer sequence is linked to the N-terminus of a first aaT that that aaT is linked to the N-terminus of a second aaT. FIG. 12E shows two different configurations of aaT-XTEN fusion proteins (101), each comprising two molecules of a single aaT, a spacer sequence and one molecule of an XTEN, the first of which has an XTEN linked to the C-terminus of a first aaT and the first aaT linked to the C-terminus of a spacer sequence which is linked to the C-terminus of a second aaT molecule, and the second of which is in the opposite configuration of XTEN linked to the N-terminus of a first aaT which is linked to the N-terminus of a spacer sequence which in turn is linked to the N-terminus of a second molecule of aaT. FIG. 12F shows a configuration of aaT-XTEN fusion protein (105), each comprising one molecule of aaT and two molecules of an XTEN linked to the N-terminus and the C-terminus of the aaT. FIG. 12G shows a configuration (106) of a single aaT linked to two XTEN, with the second XTEN separated from the aaT by a spacer sequence. FIG. 12H shows a configuration (106) of a two aaT linked to two XTEN, with the second XTEN linked to the C-terminus of the first aaT and the N-terminus of the second aaT, which is at the C-terminus of the aaT-XTEN.

FIG. 14A shows an exemplary expression vector encoding XTEN fused to the 3' end of the sequence encoding aaT. Note that no additional leader sequences are required in this vector. FIG. 14B depicts an expression vector encoding XTEN fused to the 5' end of the sequence encoding aaT with a CBD leader sequence and a TEV protease site. FIG. 14C depicts an expression vector as in FIG. 14B where the CBD and TEV processing site have been replaced with an optimized N-terminal leader sequence (NTS). FIG. 14D depicts an expression vector encoding an NTS sequence, an XTEN, a sequence encoding aaT, and then a second sequence encoding an XTEN.

DETAILED DESCRIPTION OF THE INVENTION

Figure 1:
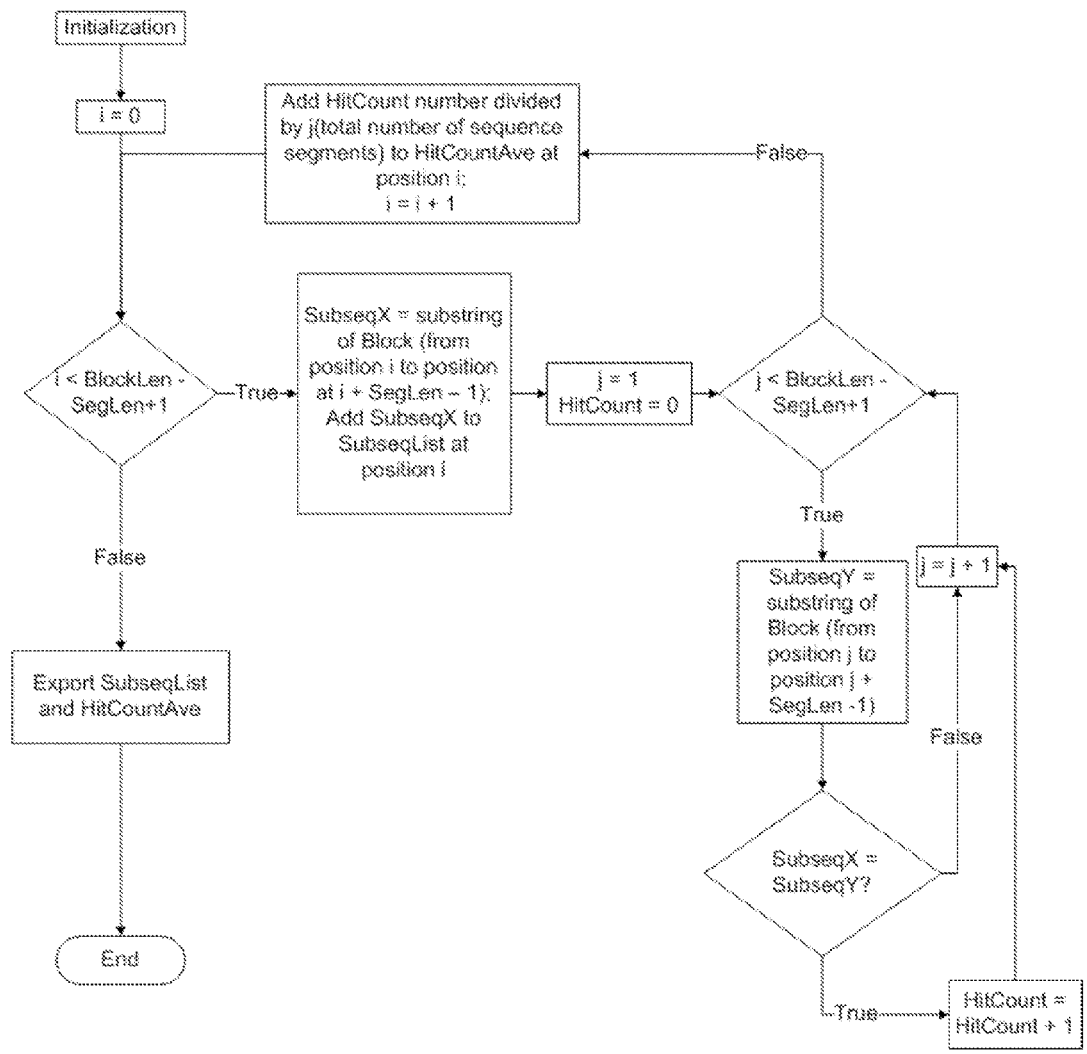
FIG. 1 is a schematic of the logic flow chart of the algorithm SegScore. In the figure the following legend applies: i, j—counters used in the control loops that run through the entire sequence; HitCount—this variable is a counter that keeps track of how many times a subsequence encounters an identical subsequence in a block; SubSeqX—this variable holds the subsequence that is being checked for redundancy; SubSeqY—this variable holds the subsequence that the SubSeqX is checked against; BlockLen—this variable holds the user determined length of the block; SegLen—this variable holds the length of a segment. The program is hardcoded to generate scores for subsequences of lengths 3, 4, 5, 6, 7, 8, 9, and 10; Block—this variable holds a string of length BlockLen. The string is composed of letters from an input XTEN sequence and is determined by the position of the i counter; SubSeqList—this is a list that holds all of the generated subsequence scores.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

In the context of the present application, the following terms have the meanings ascribed to them unless specified otherwise:

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

The term "amino acid" refers to either natural and/or unnatural or synthetic amino acids, including but not limited to both the D or L optical isomers, and amino acid analogs and peptidomimetics. Standard single or three letter codes are used to designate amino acids.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" is a truncated form of a native biologically active protein that retains at least a portion of the therapeutic and/or biological activity. A "variant" is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity compared with the reference biologically active protein. As used herein, the term "biologically active protein moiety" includes proteins modified deliberately, as for example, by site directed mutagenesis, insertions, or accidentally through mutations.

The term "sequence variant" means polypeptides that have been modified compared to their native or original sequence by one or more amino acid insertions, deletions, or substitutions. Insertions may be located at either or both termini of the protein, and/or may be positioned within internal regions of the amino acid sequence. A non-limiting example would be insertion of an XTEN sequence within the sequence of the biologically-active payload protein. In deletion variants, one or more amino acid residues in a polypeptide as described herein are removed. Deletion variants, therefore, include all fragments of a payload polypeptide sequence. In substitution variants, one or more amino acid residues of a polypeptide are removed and replaced with alternative residues. In one aspect, the substitutions are conservative in nature and conservative substitutions of this type are well known in the art.

As used herein, "internal XTEN" refers to XTEN sequences that have been inserted into the sequence of the aaT. Internal XTENs can be constructed by insertion of an XTEN sequence into the sequence of aaT by insertion between two adjacent amino acids or wherein XTEN replaces a partial, internal sequence of the aaT.

As used herein, "terminal XTEN" refers to XTEN sequences that have been fused to or in the N- or C-terminus of the aaT or to a proteolytic cleavage sequence at the N- or C-terminus of the aaT. Terminal XTENs can be fused to the native termini of the aaT. Alternatively, terminal XTENs can replace a terminal sequence of the aaT.

The term "XTEN release site" refers to a cleavage sequence in aaT-XTEN fusion proteins that can be recognized and cleaved by a mammalian protease, effecting release of an XTEN or a portion of an XTEN from the aaT-XTEN fusion protein. As used herein, "mammalian protease" means a protease that normally exists in the body fluids, cells or tissues of a mammal. XTEN release sites can be engineered to be cleaved by various mammalian proteases (a.k.a. "XTEN release proteases") such as FXIa, FXIIa, kallikrein, FVIIa, FVIIIa, FXa, FIIa (thrombin), Elastase-2, MMP-12, MMP13, MMP-17, MMP-20, or any protease that is present during a clotting or inflammatory event.

"Activity" as applied to form(s) of an aaT-XTEN polypeptide provided herein, refers to retention of a biological activity of the native aaT, wherein "biological activity" refers to an in vitro or in vivo biological function or effect, including but not limited to either receptor or ligand binding, enzymatic activity, or an effect generally known in the art for the aaT.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two or more chemical elements or components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two or more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed in a host cell.

The terms "gene" and "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" refers to sequence similarity or interchangeability between two or more polynucleotide sequences or two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity compared to those sequences.

"Ligation" refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al., "Molecular Cloning: A Laboratory Manual," 3$^{rd}$ edition, Cold Spring Harbor Laboratory Press, 2001. Typically, blocking reagents are used to block non-specific hybridization. Such blocking reagents include, for instance, sheared and denatured salmon sperm DNA at about 100-200 µg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10, or less than 9, or less than 8, or less than 7, or less than 6, or less than 5, or that there isn't a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Active clearance" means the mechanisms by which aaT is removed from the circulation other than by filtration, and which includes removal from the circulation mediated by cells, receptors, metabolism, or degradation of the aaT.

"Apparent molecular weight factor" and "apparent molecular weight" are related terms referring to a measure of the relative increase or decrease in apparent molecular weight exhibited by a particular amino acid sequence. The apparent molecular weight is determined using size exclusion chromatography (SEC) and similar methods compared to globular protein standards and is measured in "apparent kDa" units. The apparent molecular weight factor is the ratio between the apparent molecular weight and the actual molecular weight; the latter predicted by adding, based on amino acid composition, the calculated molecular weight of each type of amino acid in the composition or by estimation from comparison to molecular weight standards in an SDS electrophoresis gel.

The terms "hydrodynamic radius" or "Stokes radius" is the effective radius (Rh in nm) of a molecule in a solution measured by assuming that it is a body moving through the solution and resisted by the solution's viscosity. In the embodiments of the invention, the hydrodynamic radius measurements of the XTEN fusion proteins correlate with the 'apparent molecular weight factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refers to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers are listed in Sambrook et al. (2001). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Non-limiting examples for activation are the reaction of a carboxyl group with carbodiimide, the conversion of a carboxyl group into an activated ester, or the conversion of a carboxyl group into an azide function.

"Controlled release agent", "slow release agent", "depot formulation" and "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" and "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker that may be cleavable or non-cleavable.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

"Activity" for the purposes herein refers to an action or effect of a component of a fusion protein consistent with that of the corresponding native biologically active protein, wherein "biological activity" refers to an in vitro or in vivo biological function or effect, including but not limited to receptor binding, antagonist activity, agonist activity, or a cellular or physiologic response.

"Inhibition constant", or "$K_i$", are used interchangeably and mean the dissociation constant of the enzyme-inhibitor complex, or the reciprocal of the binding affinity of the inhibitor to the enzyme.

As used herein, "treat" or "treating," or "palliating" or "ameliorating" are used interchangeably and mean administering a drug or a biologic to achieve a therapeutic benefit, to cure or reduce the severity of an existing disease, disorder or condition, or to achieve a prophylactic benefit, prevent or reduce the likelihood of onset or severity the occurrence of a disease, disorder or condition. By therapeutic benefit is meant eradication or amelioration of the underlying disorder being treated or one or more of the physiological symptoms associated with the underlying disorder such that an improvement is observed in the subject, notwithstanding that the subject may still be afflicted with the underlying disorder.

A "therapeutic effect" or "therapeutic benefit," as used herein, refers to a physiologic effect, including but not limited to the cure, mitigation, amelioration, or prevention of disease in humans or other animals, or to otherwise enhance physical or mental wellbeing of humans or animals, caused by a fusion polypeptide of the invention other than the ability to induce the production of an antibody against an antigenic epitope possessed by the biologically active protein. For prophylactic benefit, the compositions may be administered to a subject at risk of developing a particular disease, or to a subject reporting one or more of the physiological symptoms of a disease, even though a diagnosis of this disease may not have been made.

The terms "therapeutically effective amount" and "therapeutically effective dose", as used herein, refer to an amount of a drug or a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial. Determination of a therapeutically effective amount is well within the capability of those skilled in the art, especially in light of the detailed disclosure provided herein.

The term "therapeutically effective dose regimen", as used herein, refers to a schedule for consecutively administered multiple doses (i.e., at least two or more) of a biologically active protein, either alone or as a part of a fusion protein composition, wherein the doses are given in therapeutically effective amounts to result in sustained beneficial effect on any symptom, aspect, measured parameter or characteristics of a disease state or condition.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," 3$^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," 11$^{th}$ Edition, McGraw-Hill, 2005; and Freshney, R. I., "Culture of Animal Cells: A Manual of Basic Technique," 4$^{th}$ edition, John Wiley & Sons, Somerset, N.J., 2000, the contents of which are incorporated in their entirety herein by reference.

II). Alpha 1-Antitrypsin

The present invention relates in part to fusion protein compositions comprising alpha 1-antitrypsin (aaT) and extended recombinant proteins (XTEN), resulting in aaT-XTEN. As used herein, "aaT" encompasses native sequence alpha-1 antitrypsin, sequence variants and truncated versions thereof, as described below.

"Alpha-1 antitrypsin" or "aaT" means an acute phase blood protein protease inhibitor belonging to the serpin superfamily and species and sequence variants thereof that includes, but is not limited to, the 394 amino acid mature form of approximately 44 kDa, as well as glycoforms. The three N-linked glycosylations sites are mainly equipped with so-called diantennary N-glycans. These glycans carry different amounts of negatively-charged sialic acids, this causes the heterogeneity observed on normal A1AT when analyzed by isoelectric focusing. Alpha 1-antitrypsin is the main protein of the alpha-globulin 1 region of human plasma.

Alpha 1-antitrypsin is encoded by a 12.2 kb, 7-exon gene at q31-31.2 on chromosome 14. Alpha 1-antitrypsin functions by presenting its reactive centre methionine residue on an exposed loop of the molecule such that it forms an ideal substrate for the enzyme neutrophil elastase. Following docking, the enzyme is translocated from the upper to the lower pole of the protein where it is inactivated. The Z mutation at amino acid Glu342Lys leads to perturbation in structure allows the reactive centre loop of one aaT molecule to lock into the A sheet of a second aaT to form a dimer, which then accumulate within the endoplasmic reticulum of hepatocytes to form the inclusions that are the hallmark of antitrypsin liver disease. Alpha 1-antitrypsin or sequence variants have been isolated, cloned or characterized, as described in U.S. Pat. No. 4,711,848 and US Pat. App. Pub. No. 20100048680.

The invention provides for the inclusion of aaT sequences in the aaT-XTEN fusion protein compositions that are identical to human aaT, sequences that have homology to aaT sequences, sequences that are natural, such as from humans, non-human primates, mammals (including domestic animals); all of which retain at least a portion of the biologic activity or biological function of native aaT. In another embodiment, the aaT is a non-natural aaT sequence variant, fragment, homolog, or a mimetic of a natural sequence that retains at least a portion of the biological activity of the corresponding native aaT. Sequences with homology to aaT may be found by standard homology searching techniques, such as NCBI BLAST, or in public databases such as Chemical Abstracts Services Databases (e.g., the CAS Registry), GenBank, The Universal Protein Resource (UniProt) and subscription provided databases such as GenSeq (e.g., Derwent).

Table 1 provides a non-limiting list of amino acid sequences of aaT that are encompassed by the aaT-XTEN fusion proteins of the invention. Any of the aaT sequences or homologous derivatives to be incorporated into the fusion protein compositions can be constructed by shuffling individual mutations into and between the amino acids of the sequences of Table 1 or by replacing the amino acids of the sequences of Table 1. The resulting aaT sequences can be evaluated for activity and those that retain at least a portion of the biological activity of the native aaT may be useful for the fusion protein compositions of this invention. In some embodiments, aaT that can be incorporated into an aaT-XTEN include proteins that have at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an amino acid sequence selected from Table 1.

TABLE 1

| aaT amino acid sequences | | |
|---|---|---|
| Name (source) | SEQ ID NO: | Amino Acid Sequence |
| aaT precursor polypeptide (human) | 1 | MPSSVSWGILLLAGLCCLVPVSLAEDPQGDAAQKTDTSHHDQDHPTFNKITPNLAEFA FSLYRQLAHQSNSTNIFFSPVSIATAFAMLSLGTKADTHDEILEGLNFNLTEIPEAQIHE GFQELLRTLNQPDSQLQLTTGNGLFLSEGLKLVDKFLEDVKKLYHSEAFTVNFGDTEE AKKQINDYVEKGTQGKIVDLVKELDRDTVFALVNYIFFKGKWERPFEVKDTEEEDFH VDQVTTVKVPMMKRLGMFNIQHCKKLSSWVLLMKYLGNATAIFFLPDEGKLQHLEN ELTHDIITKFLENEDRRSASLHLPKLSITGTYDLKSVLGQLGITKVFSNGADLSGVTEEA PLKLSKAVHKAVLTIDEKGTEAAGAMFLEAIPMSIPPEVKFNKPFVFLMIEQNTKSPLF MGKVVNPTQK |

TABLE 1-continued aaT amino acid sequences

| Name (source) | SEQ ID NO: | Amino Acid Sequence |
|---|---|---|
| aaT (human) | 2 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPMSIPPEVKFNKPFVFLMIEQNTKSPLFMGKVVNPTQK |
| aaT variant SEQ ID NO: 2 US Pat App 20100048680 | 3 | MPSSVSWGILLLAGLCCLVPVSLAEDPQGDAAQKTDTSHHDQDHPTFNKITPNLAEFA FSLYRQLAHQSNSTNIFFSPVSIATAFAMLSLGTKADTHDEILEGLNFNLTEIPEAQIHE GFQELLRTLNQPDSQLQLTTGNGLFLSEGLKLVDKFLEDVKKLYHSEAFTVNFGDTEE AKKQINDYVEKGTQGKIVDLVKELDRDTVFALVNYIFFKGKWERPPFEVKDTEEEDFH VDQATTVKVPMMKRLGMFNIQHCKKLSSWVLLMKYLGNATAIFFLPDEGKLQHLEN ELTHDIITKFLENEDRRSASLHLPKLSITGTYDLKSVLGQLGITKVFSNGADLSGVTEEA PLKLSKAVHKAVLTIDRGHVFRGHTHVYPPRGQVQQTLCLLND |
| aaT variant U.S. Pat. No. 4,711,848 | 4 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPMSIPPEVKFNKPFVFLMIEQNTKSPLFMGKVVNPTQK |
| aaT variant U.S. Pat. No. 4,711,848 | 5 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPASIPPEVKFNKPFVFLMIEQNTKSPLFMGKVVNPTQK |
| aaT variant U.S. Pat. No. 4,711,848 | 6 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPVSIPPEVKFNKPFVFLMIEQNTKSPLFMGKVVNPTQK |
| aaT variant U.S. Pat. No. 4,711,848 | 7 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPGSIPPEVKFNKPFVFLMIEQNTKSPLFMGKVVNPTQK |
| aaT variant U.S. Pat. No. 4,711,848 | 8 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPFSIPPEVKFNKPFVFLMIEQNTKSPLFMGKVVNPTQK |
| aaT variant U.S. Pat. No. 4,711,848 | 9 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPRSIPPEVKFNKPFVFLMIEQNTKSPLFMGKVVNPTQK |
| aaT variant U.S. Pat. No. 4,711,848 | 10 | EDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGL FLSEGLKLVDKFLEDVKKLYHSEAFTVNFGDTEEAKKQINDYVEKGTQGKIVDLVKE LDRDTVFALVNYIFFKGKWERPFEVKDTEEEDFHVDQVTTVKVPMMKRLGMFNIQH CKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAA GAMFLEAIPKSIPPEVKFNKPFVFLMIEQNTKSPLFMGKVVNPTQK |

TABLE 1-continued aaT amino acid sequences

| Name (source) | SEQ ID NO: | Amino Acid Sequence |
|---|---|---|
| aaT (mouse) | 11 | EDVQETDTSQKDQSPASHEIATNLGDFAISLYRELVHQSNTSNIFFSPVSIATAFAMLSL GSKGDTHTQILEGLQFNLTQTSEADIHKSFQHLLQTLNRPDSELQLSTGNGLFVNNDL KLVEKFLEEAKNHYQAEVFSVNFAESEEAKKVINDFVEKGTQGKIAEAVKKLDQDTV FALANYILFKGKWKKPFDPENTEEAEFHVDESTTVKVPMMTLSGMLHVHHCSTLSSW VLLMDYAGNATAVFLLPDDGKMQHLEQTLSKELISKFLLNRRRRLAQIHFPRLSISGE YNLKTLMSPLGITRIFNNGADLSGITEENAPLKLSQAVHKAVLTIDETGTEAAAVTVLQ MVPMSMPPILRFDHPFLFIIFEEHTQS PIFLGKVVDPTHK |
| aaT (bovine) | 12 | GVLQGHAVQETDDTSHQEAACHKIAPNLANFAFSIYHHLAHQSNTSNIFFSPVSIASAF AMLSLGAKGNTHTEILKGLGFNLTELAEAEIHKGFQHLLHTLNQPNHQLQLTTGNGLF INESAKLVDTFLEDVKNLYHSEAFSINFRDAEEAKKKINDYVEKGSHGKIVELVKVLD PNTVFALVNYISFKGKWEKPFEMKHTTERDFHVDEQTTVKVPMMNRLGMFDLHYCD KLASWVLLLDYVGNVTACFILPDLGKLQQLEDKLNNELLAKFLEKKYASSANLHLPK LSISETYDLKSVLGDVGITEVFSDRADLSGITKEQPLKVSKALHKAALTIDEKGTEAVG STFLEAIPMSLPPDVEFNRPFLCILYDRNTKSPLFVGKVVNPTQA |
| aaT (pig) | 13 | EGLQGHAVQETDVPRHDHEQHQEAACHRIAPNLADFAFSLYRQVARQSNTSNIFLSPV TIARAFAMLSLGTKGATHAEILEGLQFNLTEKAEAEIHEGFQHLLHTLNQPDNQLQLT TGNGLFIDEKAKLVPKFLEDVKNLYHSEAFSINFRDTEEAKKCINDYVEKGSQGKIVD LVDELDKDTVFALVNYIFFKGKWEKPFEVEQTTEEDFHVDEETTVKVPMMNRLGMF DLHHCDKLSSWVLLMDYVATATAFFILPDQGKLHQLEDMLTKEIRAKFLEKRYPSSA NLHLPKLTISGTYDLKSLLGNLGITKVFSDEADLSGVTEEQPLKLSKALHRAVLTIDEK GTEATGATILEAIPMSIPPNVKFNKPFLFLIYDTKTKAVLFMGKVMNPTQ |
| aaT (baboon) | 14 | EDPQGDAAQKTDTPPHDQNHPTLNKITPSLAEFAFSLYRQLAHQSNSTNIFFSPVSIAT AFAMLSLGTKADTHSEILEGLNFNLTEIPEAQVHEGFQELLRTLNKPDSQLQLTTGNGL FLNKSLKVVDKFLEDVKNLYHSEAFSVNFEDTEEAKKQINNYVEKGTQGKVVDLVKE LDRDTVFALVNYIFFKGKWERPFEVEATEEEDFHVDQATTVKVPMMRRLGMFNIYHC EKLSSWVLLMKYLGNATAIFFLPDEGKLQHLENELTHDIITKFLENENRRSANLHLPKL AITGTYDLKTVLGHLGITKVFSNGADLSGVTEDAPLKLSKAVHKAVLTIDEKGTEAAG AMFLEAIPMSIPPEVKFNKPFVFLMIEQNTKSPLFIGKVVNPTQK |

The aaT of the subject compositions are not limited to native, full-length aaT polypeptides, but also include recombinant versions as well as biologically and/or pharmacologically active forms with sequence variants, combinations of aaT and aaT sequences, or fragments thereof. For example, it will be appreciated that various amino acid deletions, insertions and substitutions can be made in the aaT to create variants without departing from the spirit of the invention with respect to the biological activity or pharmacologic properties of the aaT. Examples of conservative substitutions for amino acids in polypeptide sequences are shown in Table 2. However, in embodiments of the aaT-XTEN in which the sequence identity of the aaT is less than 100% compared to a specific sequence disclosed herein, the invention contemplates substitution of any of the other 19 natural L-amino acids for a given amino acid residue of the given aaT, which may be at any position within the sequence of the aaT, including adjacent amino acid residues. If any one substitution results in an undesirable change in biological activity, then one of the alternative amino acids can be employed and the construct protein evaluated by the methods described herein (e.g., the assays of Table 39), or using any of the techniques and guidelines for conservative and non-conservative mutations set forth, for instance, in U.S. Pat. No. 5,364,934, the content of which is incorporated by reference in its entirety, or using methods generally known in the art. In addition, variants can include, for instance, polypeptides wherein one or more amino acid residues are added or deleted at the N- or C-terminus of the full-length native amino acid sequence of an aaT that retains some if not all of the biological activity of the native peptide; e.g., the ability to inactivate a protease such as trypsin or elastase.

TABLE 2

Exemplary conservative amino acid substitutions

| Original Residue | Exemplary Substitutions |
|---|---|
| Ala (A) | val; leu; ile |
| Arg (R) | lys; gln; asn |
| Asn (N) | gln; his; lys; arg |
| Asp (D) | Glu |
| Cys (C) | Ser |
| Gln (Q) | Asn |
| Glu (E) | Asp |
| Gly (G) | Pro |
| His (H) | asn: gln: lys: arg |
| Ile (I) | leu; val; met; ala; phe: norleucine |
| Leu (L) | norleucine: ile: val; met; ala: phe |
| Lys (K) | arg: gln: asn |
| Met (M) | leu; phe; ile |
| Phe (F) | leu: val: ile; ala |
| Pro (P) | Gly |
| Ser (S) | Thr |
| Thr (T) | Ser |
| Trp (W) | Tyr |
| Tyr (Y) | Trp: phe: thr: ser |
| Val (V) | Ile; leu; met; phe; ala; norleucine |

Sequence variants of alpha 1-antitrypsin, whether exhibiting substantially the same or better bioactivity than wild-type alpha 1-antitrypsin, or, alternatively, exhibiting substantially modified or reduced bioactivity relative to wild-type alpha 1-antitrypsin, include, without limitation, polypeptides having an amino acid sequence that differs from the sequence of wild-type alpha 1-antitrypsin by insertion, deletion, or substitution of one or more amino acids. Such aaT variants are known in the art, including those described in U.S. Pat. No. 4,711,848 or US Pat. App. No. 20100048680; which are incorporated herein by reference.

III). Xtended Recombinant Polypeptides

In one aspect, the invention provides XTEN polypeptide compositions that are useful as fusion protein partner(s) to link to an aaT sequence, resulting in an aaT-XTEN fusion protein. XTEN are generally polypeptides with non-naturally occurring, substantially non-repetitive sequences that are composed mainly of small hydrophilic amino acids, with the sequence having a low degree of or no secondary or tertiary structure under physiologic conditions. As used herein, "XTEN" specifically excludes whole antibodies or antibody fragments (e.g. single-chain antibodies and Fc fragments). XTENs have utility as a fusion protein partners in that they serve in various roles, conferring certain desirable pharmacokinetic, physicochemical and pharmaceutical properties when linked to an aaT protein to a create an aaT-XTEN fusion protein.

The selection criteria for the XTEN to be fused to the biologically active proteins generally relate to attributes of physicochemical properties and conformational structure of the XTEN that is, in turn, used to confer the enhanced properties to the fusion proteins compositions. The XTEN of the present invention exhibit one or more of the following advantageous properties: conformational flexibility, reduced or lack of secondary structure, high degree of aqueous solubility, high degree of protease resistance, low immunogenicity, low binding to mammalian receptors, a defined degree of charge, and increased hydrodynamic (or Stokes) radii; properties that make them particularly useful as fusion protein partners. In turn, non-limiting examples of the enhanced properties of the fusion proteins comprising aaT fused to the XTEN include increases in the overall solubility and/or metabolic stability, reduced susceptibility to proteolysis, reduced immunogenicity, reduced rate of absorption when administered subcutaneously or intramuscularly, reduced binding to aaT clearance receptors, enhanced interactions with substrate, and enhanced pharmacokinetic properties. Enhanced pharmacokinetic properties of the inventive aaT-XTEN compositions include longer terminal half-life and increased area under the curve (AUC), lower volume of distribution, slower absorption after subcutaneous or intramuscular injection (compared to aaT not linked to the XTEN and administered by a similar route) such that the $C_{max}$ is lower, which, in turn, results in reductions in adverse effects of the aaT that, collectively, results in an increased period of time that a fusion protein of an aaT-XTEN composition administered to a subject provides therapeutic activity. In addition, it is believed that the aaT-XTEN compositions comprising cleavage sequences (described more fully, below) permit sustained release of biologically active aaT, such that the subcutaneously or intramuscularly administered aaT-XTEN acts as a depot. It is specifically contemplated that the subject aaT-XTEN fusion proteins of the disclosure can exhibit one or more or any combination of the improved properties disclosed herein. As a result of these enhanced properties, it is believed that aaT-XTEN compositions permit less frequent dosing compared to aaT not linked to the XTEN and administered in a comparable fashion. Such aaT-XTEN fusion protein compositions have utility to treat certain alpha 1-antitrypsin-related diseases, disorders or conditions, as described herein.

A variety of methods and assays are known in the art for determining the physicochemical properties of proteins such as the compositions comprising the inventive XTEN. Such properties include but are not limited to secondary or tertiary structure, solubility, protein aggregation, melting properties, contamination and water content. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau, et al., Prot Expr and Purif (2006) 48, 1-13.

In one embodiment, XTEN is designed to behave like denatured peptide sequence under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some embodiments, the invention provides XTEN sequences that, under physiologic conditions, resemble denatured sequences that are largely devoid in secondary structure. In other cases, the XTEN sequences are substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the methods described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In one embodiment, the XTEN sequences used in the subject fusion protein compositions have an alpha-helix percentage ranging from 0% to less than about 5% as determined by the Chou-Fasman algorithm. In another embodiment, the XTEN sequences of the fusion protein compositions have a beta-sheet percentage ranging from 0% to less than about 5% as determined by the Chou-Fasman algorithm. In some embodiments, the XTEN sequences of the fusion protein compositions have an alpha-helix percentage ranging from 0% to less than about 5% and a beta-sheet percentage ranging from 0% to less than about 5% as determined by the Chou-Fasman algorithm. In one embodiment, the XTEN sequences of the fusion protein compositions have an alpha-helix percentage less than about 2% and a beta-sheet percentage less than about 2%. The XTEN sequences of the fusion protein compositions have a high degree of random coil percentage, as determined by the GOR algorithm. In some embodiments, an XTEN sequence have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by the GOR algorithm. In one embodiment, the XTEN sequences of the fusion protein compositions have an alpha-helix percentage ranging from 0% to less than about 5% and a beta-sheet percentage ranging from 0% to less than about 5% as determined by the Chou-Fasman algorithm and at least about 90% random coil, as determined by the GOR algorithm. In another embodiment, the XTEN sequences of the fusion protein compositions have an alpha-helix percentage less than about 2% and a beta-sheet percentage less than about 2% at least about 90% random coil, as determined by the GOR algorithm.

1. Non-Repetitive Sequences

It is specifically contemplated that the XTEN sequences of the aaT-XTEN embodiments are substantially non-repetitive. In general, repetitive amino acid sequences have a tendency to aggregate or form higher order structures, as exemplified by natural repetitive sequences such as collagens and leucine zippers. These repetitive amino acids may also tend to form contacts resulting in crystalline or pseudocrystalline structures. In contrast, the low tendency of non-repetitive sequences to aggregate enables the design of long-sequence XTENs with a relatively low frequency of charged amino acids that would otherwise be likely to aggregate if the sequences were repetitive. In one embodiment, the XTEN sequences have greater than about 36 to about 1000 amino acid residues, or greater than about 100 to about 3000 amino acid residues in which no three contiguous amino acids in the sequence are identical amino acid types unless the amino acid is serine, in which case no more than three contiguous amino acids are serine residues. In the foregoing embodiment, the XTEN sequence is "substantially non-repetitive." In another embodiment, as described more fully below, the XTEN sequences of the compositions comprise non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif. In the foregoing embodiment, the XTEN sequence is "substantially non-repetitive."

Figure 2:
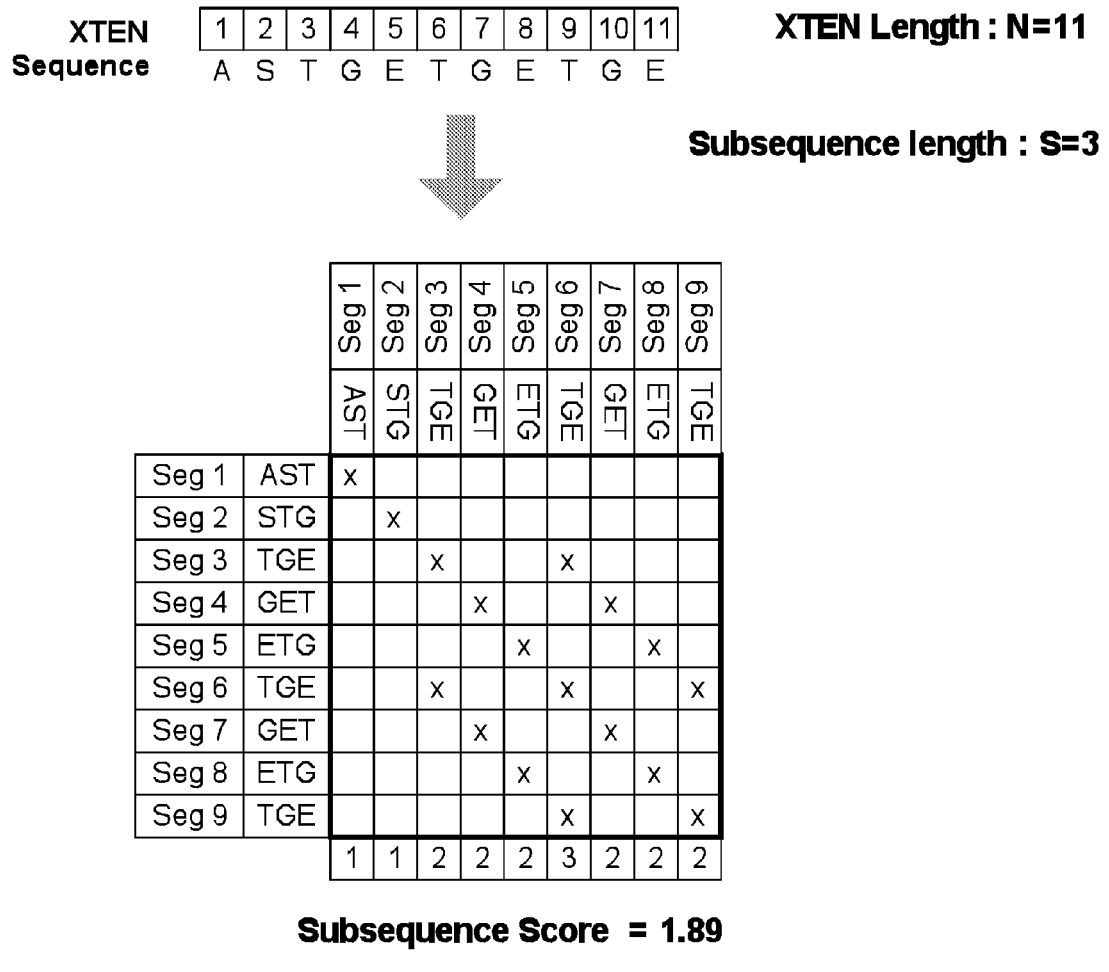
FIG. 2 depicts the application of the algorithm SegScore to a hypothetical XTEN of 11 amino acids (SEQ ID NO: 819) in order to determine the repetitiveness. An XTEN sequence consisting of N amino acids is divided into N−S+1 subsequences of length S (S=3 in this case). A pair-wise comparison of all subsequences is performed and the average number of identical subsequences is calculated to result, in this case, in a subsequence score of 1.89.
Figure 4:
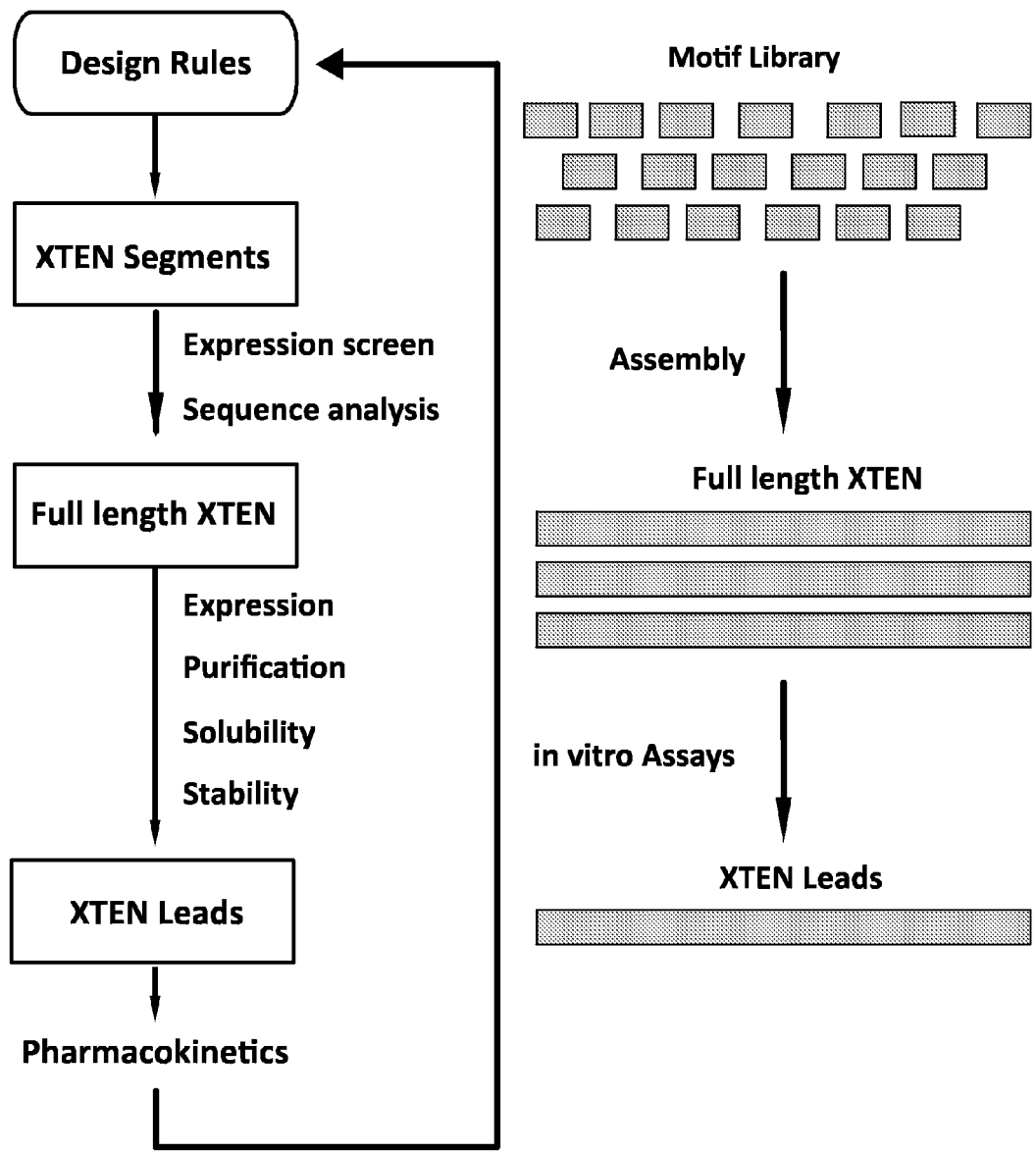
FIG. 4 is a schematic flowchart of representative steps in the assembly, production and the evaluation of a XTEN.

The degree of repetitiveness of a polypeptide or a gene can be measured by computer programs or algorithms or by other means known in the art. According to the current invention, algorithms to be used in calculating the degree of repetitiveness of a particular polypeptide, such as an XTEN, are disclosed herein, and examples of sequences analyzed by algorithms are provided (see Examples, below). In one embodiment, the repetitiveness of a polypeptide of a predetermined length can be calculated (hereinafter "subsequence score") according to the formula given by Equation 1:

Subsequence score $$\frac{\sum_{i=1}^{m} Count_i}{m} = 1$$

wherein: m=(amino acid length of polypeptide)−(amino acid length of subsequence)+1; and $Count_i$=cumulative number of occurrences of each unique subsequence within $sequence_i$ An algorithm termed "SegScore" was developed to apply the foregoing equation to quantitate repetitiveness of polypeptides, such as an XTEN, providing the subsequence score wherein sequences of a predetermined amino acid length are analyzed for repetitiveness by determining the number of times (a "count") a unique subsequence of length "s" appears in the set length, divided by the absolute number of subsequences within the predetermined length of the sequence. FIG. 1 depicts a logic flowchart of the SegScore algorithm, while FIG. 2 portrays a schematic of how a subsequence score is derived for a fictitious XTEN with 11 amino acids and a subsequence length of 3 amino acid residues. For example, a predetermined polypeptide length of 200 amino acid residues has 192 overlapping 9-amino acid subsequences and 198 3-mer subsequences, but the subsequence score of any given polypeptide will depend on the absolute number of unique subsequences and how frequently each unique subsequence (meaning a different amino acid sequence) appears in the predetermined length of the sequence. In the context of the present invention wherein the algorithm is used to determine the degree of repetitiveness in a polypeptide, the variable "amino acid length of polypeptide" is set to 200 amino acids and the variable "amino acid length of subsequence" is set to 3 amino acids. Thus, the subsequence score will equal the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 33.

In one embodiment, the present invention provides aaT-XTEN comprising one XTEN in which the XTEN has a subsequence score of less than 10, or less than 9, or less than 8, or less than 7, or less than 6, or less than 5, or less. In another embodiment, the invention provides aaT-XTEN comprising two more XTEN in which at least one XTEN has a subsequence score of less than 10, or less than 9, or less than 8, or less than 7, or less than 6, or less than 5, or less. In yet another embodiment, the invention provides aaT-XTEN comprising at least two XTEN in which each individual XTEN of 36 or more amino acids has a subsequence score of less than 10, or less than 9, or less than 8, or less than 7, or less than 6, or less than 5, or less. In the embodiments of this paragraph, the XTEN is characterized as "substantially non-repetitive".

It is believed that the non-repetitive characteristic of XTEN of the present invention contributes to many of the enhanced physicochemical and biological properties of the aaT-XTEN fusion proteins; either solely or in conjunction with the choice of the particular types of amino acids that predominate in the XTEN of the compositions disclosed herein. These properties include a higher degree of expression of the fusion protein in the host cell, greater genetic stability of the gene encoding XTEN, and a greater degree of solubility and less tendency to aggregate of the resulting aaT-XTEN compared to fusion proteins comprising polypeptides having repetitive sequences. These properties permit more efficient manufacturing, lower cost of goods, and facilitate the formulation of XTEN-comprising pharmaceutical preparations containing extremely high drug concentrations, in some cases exceeding 100 mg/ml. Furthermore, the XTEN polypeptide sequences of the embodiments are designed to have a low degree of internal repetitiveness in order to reduce or substantially eliminate immunogenicity when administered to a mammal. Polypeptide sequences composed of short, repeated motifs largely limited to only three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25 :1676-82; Yankai, Z., et al. (2006) Biochem Biophys Res Commun, 345 :1365-71; Hsu, C. T., et al. (2000) Cancer Res, 60:3701-5); Bachmann M F, et al. Eur J Immunol (1995) 25(12):3445-3451).

2. Exemplary Sequence Motifs

The present invention encompasses XTEN used as fusion partners that comprise multiple units of shorter sequences, or motifs, in which the amino acid sequences of the motifs are non-repetitive. The non-repetitive property is met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is designed to render the sequence substantially non-repetitive.

In one embodiment, the XTEN has a non-repetitive sequence of greater than about 36 to about 3000 amino acid residues wherein at least about 80%, or at least about 85%, or at least about 90%, or at least about 95%, or at least about 97%, or about 100% of the XTEN sequence consists of non-overlapping sequence motifs, wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence component consists of non-overlapping sequence motifs wherein each of the motifs has 12 amino acid residues. In these embodiments, it is preferred that the sequence motifs be composed mainly or exclusively of small hydrophilic amino acids, such that the overall sequence has an unstructured, flexible characteristic. Examples of amino acids that are included in XTEN are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with enhanced characteristics mainly include glycine (G), alanine (A), serine (S), threonine (T), glutamate (E) and proline (P) residues wherein the sequences are designed to be substantially non-repetitive. In one embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 36 to about 3000 amino acid residues in length. In some embodiments, XTEN have sequences of greater than about 36 to about 3000 amino acid residues wherein at least about 80% of the sequence consists of non-overlapping sequence motifs wherein each of the motifs has 9 to 36 amino acid residues wherein each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 30%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P), and wherein the content of any one amino acid type in the full-length XTEN does not exceed 30%.

In still other embodiments, XTENs comprise non-repetitive sequences of greater than about 36 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of four to six types of amino acids selected from glycine (G), alanine (A), serine (S), threonine (T), glutamate (E) and proline (P), and wherein the sequence of any two contiguous amino acid residues in any one sequence motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif. In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. In the foregoing embodiments hereinabove described in this paragraph, the XTEN sequences are "substantially non-repetitive."

In some embodiments, the invention provides compositions comprising one, or two, or three, or four or more non-repetitive XTEN sequence(s) of about 36 to about 1000 amino acid residues, or cumulatively about 100 to about 3000 amino acid residues wherein at least about 80%, or at least about 90%, or about 91%, or about 92%, or about 93%, or about 94%, or about 95%, or about 96%, or about 97%, or about 98%, or about 99% to about 100% of the sequence consists of multiple units of two or more non-overlapping sequence motifs selected from the amino acid sequences of Table 3, wherein the overall sequence remains substantially non-repetitive. In some embodiments, the XTEN comprises non-overlapping sequence motifs in which about 80%, or at least about 85%, or at least about 90%, or about 91%, or about 92%, or about 93%, or about 94%, or about 95%, or about 96%, or about 97%, or about 98%, or about 99% or about 100% of the sequence consists of multiple units of two or more non-overlapping sequences selected from a single motif family selected from Table 3, resulting in a family sequence. As used herein, "family" means that the XTEN has motifs selected only from a single motif category from Table 3; i.e., AD, AE, AF, AG, AM, AQ, BC, or BD XTEN, and that any other amino acids in the XTEN not from a family motif are selected to achieve a needed property, such as to permit incorporation of a restriction site by the encoding nucleotides, incorporation of a cleavage sequence, or to achieve a better linkage to an aaT component.

TABLE 3

XTEN Sequence Motifs of 12 Amino Acids and Motif Families

| Motif Family* | SEQ ID NO: | MOTIF SEQUENCE |
|---|---|---|
| AD | 15 | GESPGGSSGSES |
| AD | 16 | GSEGSSGPGESS |
| AD | 17 | GSSESGSSEGGP |
| AD | 18 | GSGGEPSESGSS |
| AE, AM | 19 | GSPAGSPTSTEE |
| AE, AM, AQ | 20 | GSEPATSGSETP |
| AE, AM, AQ | 21 | GTSESATPESGP |
| AE, AM, AQ | 22 | GTSTEPSEGSAP |
| AF, AM | 23 | GSTSESPSGTAP |
| AF, AM | 24 | GTSTPESGSASP |
| AF, AM | 25 | GTSPSGESSTAP |

TABLE 3-continued

XTEN Sequence Motifs of 12 Amino Acids and Motif Families

| Motif Family* | SEQ ID NO: | MOTIF SEQUENCE |
|---|---|---|
| AF, AM | 26 | GSTSSTAESPGP |
| AG, AM | 27 | GTPGSGTASSSP |
| AG, AM | 28 | GSSTPSGATGSP |
| AG, AM | 29 | GSSPSASTGTGP |
| AG, AM | 30 | GASPGTSSTGSP |
| AQ | 31 | GEPAGSPTSTSE |
| AQ | 32 | GTGEPSSTPASE |
| AQ | 33 | GSGPSTESAPTE |
| AQ | 34 | GSETPSGPSETA |
| AQ | 35 | GPSETSTSEPGA |
| AQ | 36 | GSPSEPTEGTSA |
| BC | 37 | GSGASEPTSTEP |
| BC | 38 | GSEPATSGTEPS |
| BC | 39 | GTSEPSTSEPGA |
| BC | 40 | GTSTEPSEPGSA |
| BD | 41 | GSTAGSETSTEA |
| BD | 42 | GSETATSGSETA |
| BD | 43 | GTSESATSESGA |
| BD | 44 | GTSTEASEGSAS |

*Denotes individual motif sequences that, when used together in various permutations, results in a "family sequence"

In some embodiments of XTEN families, an XTEN sequence comprises multiple units of non-overlapping sequence motifs of the AD, AE, AF, AG, AM, AQ, BC, or BD motif family, with the resulting XTEN exhibiting the range of homology described above. In other embodiments, the XTEN comprises multiple units of motif sequences from two or more of the motif families of Table 3, selected to achieve desired physicochemical characteristics, such as net charge, lack of secondary structure, or lack of repetitiveness that may be conferred by the amino acid composition of the motifs, described more fully below. In the embodiments hereinabove described in this paragraph, the motifs incorporated into the XTEN can be selected and assembled using the methods described herein to achieve an XTEN of about 36 to about 3000 amino acid residues. Non-limiting examples of XTEN family sequences are presented in Table 4.

TABLE 4

XTEN Polypeptides

| XTEN Name | SEQ ID NO: | Amino Acid Sequence |
|---|---|---|
| AE42_1 | 45 | TEPSEGSAPGSPAGSPTSTEEGTSESATPESGPGSEPATSGS |
| AE42_2 | 46 | PAGSPTSTEEGTSTEPSEGSAPGTSESATPESGPGSEPATSG |
| AE42_3 | 47 | SEPATSGSETPGTSESATPESGPGTSTEPSEGSAPGSPAGSP |

TABLE 4-continued

XTEN Polypeptides

| XTEN Name | SEQ ID NO: | Amino Acid Sequence |
|---|---|---|
| AG42_1 | 48 | GAPSPSASTGTGPGTPGSGTASSSPGSSTPSGATGSPGPSGP |
| AG42_2 | 49 | GPGTPGSGTASSSPGSSTPSGATGSPGSSPSASTGTGPGASP |
| AG42_3 | 50 | SPSASTGTGPGASPGTSSTGSPGTPGSGTASSSPGSSTPSGA |
| AG42_4 | 51 | SASTGTGPGASPGTSSTGSPGTPGSGTASSSPGSSTPSGATG |
| AE48 | 52 | MAEPAGSPTSTEEGTPGSGTASSSPGSSTPSGATGSPGASPGTSSTGS |
| AM48 | 53 | MAEPAGSPTSTEEGASPGTSSTGSPGSSTPSGATGSPGSSTPSGATGS |
| AE144 | 54 | GSEPATSGSETPGTSESATPESGPGSEPATSGSETPGSPAGSPTSTEEGTSTEPSEGSAPGSE PATSGSETPGSEPATSGSETPGSEPATSGSETPGTSTEPSEGSAPGTSESATPESGPGSEPAT SGSETPGTSTEPSEGSAP |
| AF144 | 55 | GTSTPESGSASPGTSPSGESSTAPGTSPSGESSTAPGSTSSTAESPGPGSTSESPSGTAPGSTS STAESPGPGTSPSGESSTAPGTSTPESGSASPGTSSTAESPGPGTSPSGESSTAPGTSPSGES STAPGTSPSGESSTAP |
| AG144_1 | 56 | PGSSPSASTGTGPGSSPSASTGTGPGTPGSGTASSSPGSSTPSGATGSPGSSPSASTGTGPGA SPGTSSTGSPGTPGSGTASSSPGSSTPSGATGSPGTPGSGTASSSPGASPGTSSTGSPGASPG TSSTGSPGTPGSGTASSS |
| AG144_2 | 57 | SGTASSSPGSSTPSGATGSPGTPGSGTASSSPGSSTPSGATGSPGSSTPSGATGSPGSSPSAS TGTGPGSSPSASTGTGPGASPGTSSTGSPGTPGSGTASSSPGSSTPSGATGSPGSSPSASTGT GPGSSPSASTGTGPGASP |
| AG144_3 | 58 | GTPGSGTASSSPGSSTPSGATGSPGSSTPSGATGSPGSSPSASTGTGPGSSPSASTGTGPGAS PGTSSTGSPGTPGSGTASSSPGSSTPSGATGSPGSSPSASTGTGPGSSPSASTGTGPGASPGT SSTGSPGASPGTSSTGSP |
| AG144_4 | 59 | GTPGSGTASSSPGSSTPSGATGSPGSSPSASTGTGPGSSPSASTGTGPGASPGTSSTGSPGAS PGTSSTGSPGSSTPSGATGSPGSSPSASTGTGPGASPGTSSTGSPGSSPSASTGTGPGTPGSG TASSSPGSSTPSGATGSP |
| AE288 | 60 | GTSESATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGPGTSESATPES GPGSEPATSGSETPGSEPATSGSETPGSPAGSPTSTEEGTSTEPSEGSAPGTSTEPSEGSAPG SEPATSGSETPGTSESATPESGPGTSTEPSEGSAP |
| AG288_1 | 61 | ASSSPGASPGTSSTGSPGASPGTSSTGSPGASPGTSSTGSPGASPGTSSTGSPGTPGSGTASS SPGSSTPSGATGSPGTPGSGTASSSPGSSTPSGATGSPGTPGSGTASSSPGSSTPSGATGSPG SSTPSGATGSPGSSPSASTGTGPGSSPSASTGTGPGASPGTSSTGSPGTPGSGTASSSPGSST PSGATGSPGSSPSASTGTGPGSSPSASTGTGPGASPGTSSTGSPGSSTPSG ATGSPGSSPSASTGTGPGASPGTSSTGSPGSSPSASTGTGPGTPGSGTASSSPGSSTPSGATGS |
| AG288_2 | 62 | PGASPGTSSTGSPGASPGTSSTGSPGTPGSGTASSSPGSSTPSGATGSPGTPGSGTASSSPGS STPSGATGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSPGSSPSASTGTGPGSSPSAST GTGPGASPGTSSTGSPGASPGTSSTGSPGSSTPSGATGSPGSSPSASTGTGPGASPGTSSTGS PGSSPSASTGTGPGTPGSGTASSSPGSSTPSGATGS |
| AG288_3 | 63 | GSSPSASTGTGPGSSPSASTGTGPGTPGSGTASSSPGSSTPSGATGSPGSSPSASTGTGPGAS PGTSSTGSPGTPGSGTASSSPGSSTPSGATGSPGTPGSGTASSSPGASPGTSSTGSPGASPGT SSTGSPGTPGSGTASSSPGSSTPSGATGSPGASPGTSSTGSPGTPGSGTASSSPGSSTPSGAT GSPGSSPSASTGTGPGSSPSASTGTGPGSSTPSGATGSPGSSTPSGATGSPGASPGTSSTGSP GASPGTSSTGSPGASPGTSSTGSPGTPGSGTASSSP |
| AF504 | 64 | GASPGTSSTGSPGSSPSASTGTGPGSSPSASTGTGPGTPGSGTASSSPGSSTPSGATGSPGSX PSASTGTGPGASPGTSSTGSPGTPGSGTASSSPGSPGTPGSGTASSSPGASPGT SSTGSPGASPGTSSTGSPGTPGSGTASSSPGSSTPSGATGSPGASPGTSSTGSPGTPGSGTAS SSPGSSTPSGATGSPGSXPSASTGTGPGSSPSASTGTGPGSSTPSGATGSPGSSTPSGATGSP GASPGTSSTGSPGASPGTSSTGSPGASPGTSSTGSPGTPGSGTASSSPGASPGTSSTGSPGAS PGTSSTGSPGASPGTSSTGSPGSSPSASTGTGPGTPGSGTASSSPGASPGTSSTGSPGASPGT SSTGSPGASPGTSSTGSPGSSTPSGATGSPGSSTPSGATGSPGASPGTSSTGSPGTPGSGTAS SSPGSSTPSGATGSPGSSTPSGATGSPGSSTPSGATGSPGSSPSASTGTGPGASPGTSSTGSP |
| AF540 | 65 | GSTSSTAESPGPGSTSSTAESPGPGSTSESPSGTAPGSTSSTAESPGPGSTSSTAESPGPGTSTP ESGSASPGSTSESPSGTAPGTSPSGESSTAPGSTSESPSGTAPGSTSESPSGTAPGTSPSGES STAPGSTSESPSGTAPGSTSESPSGTAPGTSPSGESSTAPGSTSESPSGTAPGSTSESPSGTAP GSTSESPSGTAPGTSTPESGSASPGSTSESPSGTAPGTSTPESGSASPGSTSSTAESPGPGSTS STAESPGPGTSTPESGSASPGTSTPESGSASPGSTSESPSGTAPGTSTPESGSASPGTSTPESG SASPGSTSESPSGTAPGSTSESPSGTAPGSTSESPSGTAPGSTSSTAESPGPGTSTPESGSASP |

TABLE 4-continued

XTEN Polypeptides

| XTEN Name | SEQ ID NO: | Amino Acid Sequence |
|---|---|---|
| | | GTSTPESGSASPGSTSESPSGTAPGSTSESPSGTAPGTSTPESGSASPGSTSESPSGTAPGSTS ESPSGTAPGTSTPESGSASPGTSPSGESSTAPGSTSSTAESPGPGTSPSGESSTAPGSTSSTAE SPGPGTSTPESGSASPGSTSESPSGTAP |
| AD576 | 66 | GSSESGSSEGGPGSGGEPSESGSSGSSESGSSEGGPGSSESGSSEGGPGSSESGSSEGGPGSS ESGSSEGGPGSSESGSSEGGPGESPGGSSGSESGSEGSSGPGESSGGSSESGSSEGGPGSSESG SSEGGPGSSESGSSEGGPGSGGEPSESGSSGESPGGSSGSESGESPGGSSGSESGSSGGEPSES GSSGSSESGSSEGGPGSGGEPSESGSSGSSGGEPSESGSSGSSESGSSGPGESSGESPGGSSGES GSSGGEPSESGSSGSGGEPSESGSSGSSGGEPSESGSSGSSESGSSEGGPGESPGGSSGSESGES PGGSSGSESGESPGGSSGSESGESPGGSSGSESGSSESGSSEGGPGSGGEP SESGSSGGSEGSSGPGESSGGSSESGSSEGGPGSGGEPSESGSSGSSESGSSEGGPGSGGEPSES GSSGESPGGSSGSESGESPGGSSGSESGSSESGSSEGGPGSGGEPSESGSSGSSESGSSEGGP GSGGEPSESGSSGSGGEPSESGSSGESPGGSSGSESGSEGSSGPGESSGGSSESGSSEGGPGSE GSSGPGESS |
| AE576 | 67 | GSPAGSPTSTEEGTSESATPESGPGTSTEPSEGSAPGSPAGSPTSTEEGTSTEPSEGSAPGTS TEPSEGSAPGTSESATPESGPGSEPATSGSETPGSEPATSGSETPGSPAGSPTSTEEGTSESA TPESGPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGSAPG TSTEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTEPSE GSAPGTSTEPSEGSAPGTSTEPSEGSAPGSPAGSPTSTEEGTSTEPSEGSAPGTSESATPESG PGSEPATSGSETPGTSESATPESGPGSEPATSGSETPGTSESATPESGPGTSTEPSEGSAPGT SESATPESGPGSPAGSPTSTEEGSPAGSPTSTEEGSPAGSPTSTEEGTSESATPESGPGTSTEP SEGSAP |
| AF576 | 68 | GSTSSTAESPGPGTSSTAESPGPGTSSESPSGTAPGSTSSTAESPGPGTSSTAESPGPGTSST PESGSASPGSTSESPSGTAPGTSPSGESSTAPGSTSESPSGTAPGSTSESPSGTAPGSTSPSGES STAPGSTSESPSGTAPGSTSESPSGTAPGTSPSGESSTAPGSTSESPSGTAPGSTSESPSGTAP GSTSESPSGTAPGTSTPESGSASPGSTSESPSGTAPGTSTPESGSASPGSTSSTAESPGPGSTS STAESPGPGTSTPESGSASPGTSTPESGSASPGSTSESPSGTAPGTSTPESGSASPGTSTPESG SASPGSTSESPSGTAPGSTSESPSGTAPGSTSESPSGTAPGSTSSTAESPGPGTSTPESGSASP GTSTPESGSASPGSTSESPSGTAPGSTSESPSGTAPGSTSESPSGTAPGSTSESPSGTAPGSTS ESPSGTAPGTSTPESGSASPGTSPSGESSTAPGSTSSTAESPGPGTSPSGESSTAPGSTSSTAE SPGPGTSTPESGSASPGSTSESPSGTAPGSTSSTAESPGPGTSTPESGSASPGTSTPESGSASP |
| AG576 | 69 | PGTPGSGTASSSPGSSTPSGATGSPGSSPSASTGTGPGSSPSASTGTGPGSSTPSGATGSPGS STPSGATGSPGASPGTSSTGSPGASPGTSSTGSPGASPGTSSTGSPGTPGSGTASSSPGASPG TSSTGSPGASPGTSSTGSPGASPGTSSTGSPGSSPSASTGTGPGTPGSSTASSSPGASPGTSS TGSPGASPGTSSTGSPGASPGTSSTGSPGSSTPSGATGSPGSSTPSGATGSPGASPGTSSTGS PGTPGSGTASSSPGSSTPSGATGSPGSSTPSGATGSPGSSPSASTGTGPGA SPGTSSTGSPGASPGTSSTGSPGTPGSGTASSSPGASPGTSSTGSPGASPG TSSTGSPGASPGTSSTGSPGTPGSGTASSSPGSSTPSGATGSPGTPGSGTASSSPGSSTPSGA TGSPGTPGSGTASSSPGSSTPSGATGSPGSSTPSGATGSPGSSPSASTGTGPGSSPSASTGTG PGASPGTSSTGSPGTPGSGTASSSPGSSTPSGATGSPGSSPSASTGTGPGSSPSASTGTGPGA SPGTSSTGS |
| AE624 | 70 | MAEPAGSPTSTEEGTPGSGTASSSPGSSTPSGATGSPGASPGTSSTGSPGSPAGSPTSTEEG TSESATPESGPGTSTEPSEGSAPGSPAGSPTSTEEGTSTEPSEGSAPGTSTEPSEGSAPGTSES ATPESGPGSEPATSGSETPGSEPATSGSETPGSPAGSPTSTEEGTSESATPESGPGTSTEPSE GSAPGTSTEPSEGSAPGSPAGSPTSTEEGTSTEPSEGSAPGTSTEPSEGSAPGTSESATPESG PGTSTEPSEGSAPGTSESATPESGPGSEPATSGSETPGTSTEPSEGSAPGTSTEPSEGSAPGT SESATPESGPGTSESATPESGPGSPAGSPTSTEEGTSESATPESGPGSEPATSGSETPGTSES ATPESGPGTSTEPSEGSAPGTSTEPSEGSAPGTSTEPSEGSAPGTSTEPSEGSAPGTSTEPSE GSAPGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESGPGSP AGSPTSTEEGSPAGSPTSTEEGSPAGSPTSTEEGTSESATPESGPGTSTEPSEGSAP |
| AD836 | 71 | GSSESGSSEGGPGSSESGSSEGGPGESPGGSSGSESGSGGEPSESGSSGESPGGSSGSESGES PGGSSGSESGSSESGSSEGGPGSSESGSSEGGPGSSESGSSEGGPGESPGGSSGSESGESPGG SSGSESGESPGGSSGSESGSSESGSSEGGPGSSESGSSEGGPGSSESGSSEGGPGSSESGSSE GGPGSSESGSSEGGPGSSESGSSEGGPGSGGEPSESGSSGSSEGSPGGSSGSESGSSEGGPGSS ESGSSEGGPGSSESGSGPGESSGGSSESGSSEGGPGSGGEPSESGSSGESPGGSSGSESGSSGGEPSESGSSGSSEGSPGGSSGSESGESPGGSSGSESGSSESGSSEGGPGSGGEPSESGSSGSSESG SSEGGPGSGGEPSESGSSGSGGEPSESGSSGESPGGSSGSESGSSGGEPSESGSSGSSESG SSEGGPGSGGEPSESGSSGESPGGSSGSESGSSGGEPSESGSSGSSGGEPSESGSSGSSESG SSEGGPGSGGEPSESGSSGSSESGSSEGGPGSSESGSSEGGPGSSESGSSEGGPGSSESG SSEGGPGSSESGSSEGGPGESPGGSSGSESGESPGGSSGSESGSSESGSSEGGPGSSESGSSE GGPGSSESGSSEGGPGSSESGSSEGGPGSGGEPSESGSSGSSESGSSEGGPGESPGGSSGSESGSSESGSSGGEPSESGSSGESPGGS SGSESGSGGEPSESGSS |

TABLE 4-continued

XTEN Polypeptides

| XTEN Name | SEQ ID NO: | Amino Acid Sequence |
|---|---|---|
| AE864 | 72 | GSPAGSPTSTEEGTSESATPESGPGTSTEPSEGSAPGSPAGSPTSTEEGTSTEPSEGSAPGTS TEPSEGSAPGTSESATPESGPGSEPATSGSETPGSEPATSGSETPGSPAGSPTSTEEGTSESA TPESGPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGSAPG TSTEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTEPSE GSAPGTSTEPSEGSAPGTSTEPSEGSAPGSPAGSPTSTEEGTSTEPSEGSAPGTSESATPESG PGSEPATSGSETPGTSESATPESGPGSEPATSGSETPGTSESATPESGPGTSTEPSEGSAPGT SESATPESGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTSESATPE SGPGTSTEPSEGSAPGSPAGSPTSTEEGTSESATPESGPGSEPATSGSETPGTSESATPESGP GSPAGSPTSTEEGSPAGSPTSTEEGTSTEPSEGSAPGTSESATPESGPGTSESATPESGPGTS ESATPESGPGSEPATSGSETPGSEPATSGSETPGSPAGSPTSTEEGTSTEPSEGSAPGTSTEPS EGSAPGSEPATSGSETPGTSESATPESGPGTSTEPSEGSAP |
| AF864 | 73 | GSTSESPSGTAPGTSPSGESSTAPGSTSESPSGTAPGSTSESPSGTAPGTSTPESGSASPGTST PESGSASPGSTSESPSGTAPGSTSESPSGTAPGTSPSGESSTAPGSTSESPSGTAPGTSPSGES STAPGTSPSGESSTAPGSTSSTAESPGPGTSPSGESSTAPGTSPSGESSTAPGSTSSTAESPGP GTSTPESGSASPGTSTPESGSASPGSTSESPSGTAPGSTSESPSGTAPGTSTPESGSASPGSTS STAESPGPGTSTPESGSASPGSTSESPSGTAPGTSPSGESSTAPGSTSSTAESPGPGTSPSGES STAPGTSTPESGSASPGSTSSTAESPGPGTSSTAESPGPGTSSTAESPGPGTSSTAESPGP GTSPSGESSTAPGSTSESPSGTAPGSTSESPSGTAPGTSTPESGPXXXGASASGAPSTXXXX SESPSGTAPGSTSESPSGTAPGSTSESPSGTAPGSTSESPSGTAPGSTSESPSGTAPGSTSESP SGTAPGTSTPESGSASPGTSPSGESSTAPGTSPSGESSTAPGTSSTAESPGPGTSPSGESSTA PGTSTPESGSASPGSTSESPSGTAPGSTSESPSGTAPGTSPSGESSTAPGSTSESPSGTAPGTS TPESGSASPGTSTPESGSASPGSTSESPSGTAPGTSTPESGSASPGSTSSTAESPGPGTSESP SGTAPGSTSESPSGTAPGTSPSGESSTAPGSTSSTAESPGPGTSPSGESSTAPGTSTPESGSAS PGTSPSGESSTAPGTSPSGESSTAPGTSPSGESSTAPGSTSSTAESPGPGTSSTAESPGPGTS PSGESSTAPGSSPSASTGTGPGSSTPSGATGSPGSSTPSGATGSP |
| AG864 | 74 | GASPGTSSTGSPGSSSPSASTGTGPGSSPSASTGTGPGTPGSGTASSSPGSSTPSGATGSPGSS PSASTGTGPGASPGTSSTGSPGTPGSGTASSSPGSSTPSGATGSPGTPGSGTASSSPGASPGT SSTGSPGASPGTSSTGSPGTPGSGTASSSPGSSTPSGATGSPGASPGTSSTGSPGTPGSGTAS SSPGSSTPSGATGSPGSSPSASTGTGPGSSPSASTGTGPGSSTPSGATGSPGSSTPSGATGSP GASPGTSSTGSPGASPGTSSTGSPGASPGTSSTGSPGTPGSGTASSSPGASPGTSSTGSPGAS PGTSSTGSPGASPGTSSTGSPGSSPSASTGTGPGTPGSGTASSSPGASPGTSSTGSPGASPGT SSTGSPGASPGTSSTGSPGSSTPSGATGSPGSSTPSGATGSPGTPGSGTAS SSPGSSTPSGATGSPGSSTPSGATGSPGSSTPSGATGSPGSSPSASTGTGPGASPGTSSTGSP GASPGTSSTGSPGTPGSGTASSSPGASPGTSSTGSPGASPGTSSTGSPGASPGTSSTGSPGAS PGTSSTGSPGTPGSGTASSSPGSSTPSGATGSPGTPGSGTASSSPGSSTPSGATGSPGTPGSG TASSSPGSSTPSGATGSPGSSTPSGATGSPGSSPSASTGTGPGSSPSASTGTGPGASPGTSST GSPGTPGSGTASSSPGSSTPSGATGSPGSSPSASTGTGPGSSPSASTGTGPGASPGTSSTGSP GASPGTSSTGSPGSSTPSGATGSPGSSPSASTGTGPGASPGTSSTGSPGSSPSASTGTGPGTP GSGTASSSPGSSTPSGATGSPGSSTPSGATGSPGASPGTSSTGSP |
| AM875 | 75 | GTSTEPSEGSAPGSEPATSGSETPGSPAGSPTSTEEGSTSSTAESPGPGTSTPESGSASPGSTS ESPSGTAPGSTSESPSGTAPGTSTPESGSASPGTSTPESGSASPGSEPATSGSETPGTSESATP ESGPGSPAGSPTSTEEGTSTEPSEGSAPGTSESATPESGPGTSTEPSEGSAPGTSTEPSEGSA PGSPAGSPTSTEEGTSTEPSEGSAPGTSTEPSEGSAPGTSESATPESGPGTSESATPESGPGT STEPSEGSAPGTSTEPSEGSAPGTSESATPESGPGTSTEPSEGSAPGSEPATSGSETPGSPAG SPTSTEEGSSTPSGATGSPGTPGSGTASSSPGSSTPSGATGSPGTSTEPSEGSAPGTSTEPSE GSAPGSEPATSGSETPGSPAGSPTSTEEGSPAGSPTSTEEGTSTEPSEGSAPGASASGAPSTG GTSESATPESGPGSPAGSPTSTEEGSPAGSPTSTEEGTSTEPSEGSPSGTAPGTSP SGESSTAPGTPGSGTASSSPGSSTPSGATGSPGSSPSASTGTGPGSEPATSGSETPGTSESAT PESGPGSEPATSGSETPGTSSTAESPGPGTSSTAESPGPGTSPSGESSTAPGSEPATSGSET PGSEPATSGSETPGTSTEPSEGSAPGTSSTAESPGPGTSTPESGSASPGTSESPSGTAPGTS TEPSEGSAPGTSTEPSEGSAPGTSTEPSEGSAPGSSTPSGATGSPGSSPSASTGTGPGASPGT SSTGSPGSEPATSGSETPGTSESATPESGPGSPAGSPTSTEEGSTPSGATGSPGSSPSASTGT GPGASPGTSSTGSPGTSESATPESGPGTSTEPSEGSAPGTSTEPSEGSAP |
| AE912 | 76 | MAEPAGSPTSTEEGTPGSGTASSSPGSSTPSGATGSPGASPGTSSTGSPGSPAGSPTSTEEG TSESATPESGPGTSTEPSEGSAPGSPAGSPTSTEEGTSTEPSEGSAPGTSES ATPESGPGSEPATSGSETPGSEPATSGSETPGSPAGSPTSTEEGTSESATPESGPGTSTEPSE GSAPGTSTEPSEGSAPGSPAGSPTSTEEGTSTEPSEGSAPGTSTEPSEGSAPGTSESATPESG PGTSTEPSEGSAPGTSESATPESGPGSEPATSGSETPGTSTEPSEGSAPGTSTEPSEGSAPGT SESATPESGPGTSESATPESGPGSPAGSPTSTEEGTSESATPESGPGSEPATSGSETPGTSES ATPESGPGTSTEPSEGSAPGTSTEPSEGSAPGTSTEPSEGSAPGTSTEPSEGSAPGTSTEPSE GSAPGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESGPGSP AGSPTSTEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPTSTEEG SPAGSPTSTEEGTSTEPSEGSAPGTSESATPESGPGTSESATPESGPGTSESATPESGPGSEP ATSGSETPGSEPATSGSETPGSPAGSPTSTEEGTSTEPSEGSAPGTSTEPSEGSAPGSEPATS GSETPGTSESATPESGPGTSTEPSEGSAP |

TABLE 4-continued

XTEN Polypeptides

| XTEN Name | SEQ ID NO: | Amino Acid Sequence |
|---|---|---|
| AM923 | 77 | MAEPAGSPTSTEEGASPGTSSTGSPGSSTPSGATGSPGSSTPSGATGSPGTSTEPSEGSAPGS<br>EPATSGSETPGSPAGSPTSTEEGSTSSTAESPGPGTSTPESGSASPGSTSESPSGTAPGSTSES<br>PSGTAPGTSTPESGSASPGTSTPESGSASPGSEPATSGSETPGTSESATPESGPGSPAGSPTST<br>EEGTSTEPSEGSAPGTSESATPESGPGTSTEPSEGSAPGTSTEPSEGSAPGSPAGSPTSTEEG<br>TSTEPSEGSAPGTSTEPSEGSAPGTSESATPESGPGTSESATPESGPGTSTEPSEGSAPGTSTE<br>PSEGSAPGTSESATPESGPGTSTEPSEGSAPGSEPATSGSETPGSPAGSPTSTEEGSSTPSGA<br>TGSPGTPGSGTASSSPGSSTPSGATGSPGTSTEPSEGSAPGTSTEPSEGSAPGSEPATSGSET<br>PGSPAGSPTSTEEGSPAGSPTSTEEGTSTEPSEGSAPGASASGAPSTGGTSESATPESGPGSP<br>AGSPTSTEEGSPAGSPTSTEEGSTSSTAESPGPGSTSESPSGTAPGTSPSGESSTAPGTPGSG<br>TASSSPGSSTPSGATGSPGSSPSASTGTGPGSEPATSGSETPGTSESATPESGPGSEPATSGS<br>ETPGSTSSTAESPGPGSTSSTAESPGPGTSPSGESSTAPGSEPATSGSETPGSEPATSGSETPG<br>TSTEPSEGSAPGSTSSTAESPGPGTSTPESGSASPGSTSESPSGTAPGTSTEPSEGSAPGTSTE<br>PSEGSAPGTSTEPSEGSAPGSSTPSGATGSPGSSPSASTGTGPGASPGTSSTGSPGSEPATSG<br>SETPGTSESATPESGPGSPAGSPTSTEEGSSTPSGATGSPGSSPSASTGTGPGASPGTSSTGS<br>PGTSESATPESGPGTSTEPSEGSAPGTSTEPSEGSAP |
| AM1318 | 78 | GTSTEPSEGSAPGSEPATSGSETPGSPAGSPTSTEEGSTSSTAESPGPGTSTPESGSASPGSTS<br>ESPSGTAPGSTSESPSGTAPGTSTPESGSASPGTSTPESGSASPGSEPATSGSETPGTSESATP<br>ESGPGSPAGSPTSTEEGTSTEPSEGSAPGTSTEPSEGSAPGTSTEPSEGSA<br>PGSPAGSPTSTEEGTSTEPSEGSAPGTSTEPSEGSAPGTSESATPESGPGTSESATPESGPGT<br>STEPSEGSAPGTSTEPSEGSAPGTSESATPESGPGTSTEPSEGSAPGSEPATSGSETPGSPAG<br>SPTSTEEGSSTPSGATGSPGTPGSGTASSSPGSSTPSGATGSPGTSTEPSEGSAPGTSTEPSE<br>GSAPGSEPATSGSETPGSPAGSPTSTEEGSPAGSPTSTEEGTSTEPSEGSAPGPEPTGPAPSG<br>GSEPATSGSETPGTSESATPESGPGSPAGSPTSTEEGTSESATPESGPGSPAGSPTSTEEGSP<br>AGSPTSTEEGTSESATPESGPGSPAGSPTSTEEGSPAGSPTSTEEGTSSTAESPGPGSTSESP<br>SGTAPGTSPSGESSTAPGSTSESPSGTAPGSTSESPSGTAPGTSPSGESSTAPGTSTEPSEGSA<br>PGTSESATPESGPGTSESATPESGPGSEPATSGSETPGTSESATPESGPGTSESATPESGPGT<br>STEPSEGSAPGTSESATPESGPGTSTEPSEGSAPGTSPSGESSTAPGTSPSGESSTAPGTSPSG<br>ESSTAPGTSTEPSEGSAPGSPAGSPTSTEEGTSTEPSEGSAPGSSPSASTGTGPGSSTPSGAT<br>GSPGSSTPSGATGSPGSSTPSGATGSPGSSTPSGATGSPGASPGTSSTGSPGASASGAPSTG<br>GTSPSGESSTAPGSTSSTAESPGPGTSPSGESSTAPGTSESATPESGPGTSTEPSEGSAPGTST<br>EPSEGSAPGSSPSASTGTGPGSSTPSGATGSPGASPGTSSTGSPGTSTPESGSASPGTSPSGE<br>SSTAPGTSPSGESSTAPGTSESATPESGPGSEPATSGSETPGTSTEPSEGSAPGTSESPSGTA<br>PGSTSESPSGTAPGTSTPESGSASPGSPAGSPTSTEEGTSESATPESGPGTSTEPSEGSAPGSP<br>AGSPTSTEEGTSESATPESGPGSEPATSGSETPGSSTPSGATGSPGASPGTSSTGSPGSSTPS<br>GATGSPGSTSESPSGTAPGTSPSGESSTAPGSTSSTAESPGPGSSTPSGATGSPGASPGTSST<br>GSPGTPGSGTASSSPGSPAGSPTSTEEGSPAGSPTSTEEGTSTEPSEGSAP |
| BC 864 | 79 | GTSTEPSEPGSAGTSTEPSEPGSAGSEPATSGTEPSGSGASEPTSTEPGSEPATSGTEPSGSE<br>PATSGTEPSGSEPATSGTEPSGSGASEPTSTEPGTSTEPSEPGSAGSEPATSGTEPSGTSTEPS<br>EPGSAGSEPATSGTEPSGSEPATSGTEPSGTSTEPSEPGSAGTSTEPSEPGSAGSEPATSGTE<br>PSGSEPATSGTEPSGTSEPSTSEPGAGSGASEPTSTEPGTSEPSTSEPGAGSEPATSGTEPSGS<br>EPATSGTEPSGTSTEPSEPGSAGTSTEPSEPGSAGSEPATSGTEPSGSEPA<br>TSGTEPSGSEPATSGTEPSGSEPATSGTEPSGTSTEPSEPGSAGSEPATSGTEPSGSGASEPT<br>STEPGTSTEPSEPGSAGSEPATSGTEPSGSGASEPTSTEPGTSTEPSEPGSAGSGASEPTSTEP<br>GSEPATSGTEPSGSGASEPTSTEPGSEPATSGTEPSGSGASEPTSTEPGTSTEPSEPGSAGSE<br>PATSGTEPSGSGASEPTSTEPGTSTEPSEPGSAGSEPATSGTEPSGTSTEPSEPGSAGSEPAT<br>SGTEPSGTSTEPSEPGSAGTSTEPSEPGSAGTSTEPSEPGSAGTSTEPSEPGSAGTSTEPSEPG<br>SAGTSTEPSEPGSAGTSEPSTSEPGAGSGASEPTSTEPGTSTEPSEPGSAGTSTEPSEPGSAG<br>TSTEPSEPGSAGSEPATSGTEPSGSGASEPTSTEPGSEPATSGTEPSGSEPATSGTEPSGSEP<br>ATSGTEPSGSEPATSGTEPSGTSEPSTSEPGAGSEPATSGTEPSGSGASEPTSTEPGTSTEPSE<br>PGSAGSEPATSGTEPSGSGASEPTSTEPGTSTEPSEPGSA |
| BD864 | 80 | GSETATSGSETAGTSESATSESGAGSTAGSETSTEAGTSESATSESGAGSETATSGSETAGS<br>ETATSGSETAGTSTEASEGSASGTSTEASEGSASGTSESATSESGAGSETATSGSETAGTST<br>EASEGSASGSTAGSETSTEAGTSESATSESGAGTSESATSESGAGSETATSGSETAGTSESA<br>TSESGAGTSTEASEGSASGSETATSGSETAGSETATSGSETAGSTAGSETSTEAGSASGSETAGSET<br>STEAGTSESATSESGAGTSTEASEGSASGSETATSGSETAGSTAGSETSTEAGTSTAGSETST<br>EAGSETATSGSETAGTSESATSESGAGTSESATSESGAGSETATSGSETAGTSESATSESGA<br>GTSESATSESGAGSETATSGSETAGSETATSGSETAGTSTEASEGSASGSTAGSETSTEAGS<br>ETATSGSETAGTSESATSESGAGSTAGSETSTEAGSTAGSETSTEAGTSTAGSETSTEAGTST<br>EASEGSASGSTAGSETSTEAGSTAGSETSTEAGTSTEASEGSASGSTAGSETSTEAGSETAT<br>SGSETAGTSTEASEGSASGTSESATSESGAGSETATSGSETAGTSESATSESGAGTSESATS<br>ESGAGSETATSGSETAGTSESATSESGAGSETATSGSETAGTSTEASEGSASGTSTEASEGS<br>ASGSTAGSETSTEAGSTAGSETSTEAGTSETATSGSETAGTSTEASEGSASGTSESATSESGA<br>GSETATSGSETAGSETATSGSETAGSETATSGSETAGTSTEASEGSASGTSESATSESGAGS<br>ETATSGSETAGSETATSGSETAGTSESATSESGAGTSESATSESGAGSETATSGSETA |
| AE948 | 81 | GTSTEPSEGSAPGTSESATPESGPGSEPATSGSETPGTSESATPESGPGTSTEPSEGSAPGSP<br>AGSPTSTEEGTSTEPSEGSAPGSEPATSGSETPGTSESATPESGPGTSESATPESGPGSEPAT<br>SGSETPGTSTEPSEGSAPGTSESATPESGPGTSTEPSEGSAPGTSTEPSEGSAPGSEPATSGS<br>ETPGTSTEPSEGSAPGSEPATSGSETPGSEPATSGSETPGTSTEPSEGSAPGSEPATSGSETP<br>GSEPATSGSETPGTSTEPSEGSAPGTSEPATSGSETPGSPAGSPTSTEEGTSESATPESGPGTS<br>TEPSEGSAPGSEPATSGSETPGTSESATPESGPGSEPATSGSETPGSEPATSGSETPGTSESA |

TABLE 4-continued

XTEN Polypeptides

| XTEN Name | SEQ ID NO: | Amino Acid Sequence |
|---|---|---|
| | | TPESGPGSPAGSPTSEEGTSESATPESGPGSPAGSPTSTEEGTSTEPSEGSAPGTSESATPES
GPGTSTEPSEGSAPGTSTEPSEGSAPGSPAGSPTSTEEGTSTEPSEGSAPGTSESATPESGPG
SPAGSPTSTEEGSPAGSPTSTEEGTSESATPESGPGTSESATPESGPGTSTEPSEGSAPGSPA
GSPTSTEEGTSESATPESGPGTSTEPSEGSAPGSEPATSGSETPGSPAGSPTSTEEGTSESATP
ESGPGTSTEPSEGSAPGSEPATSGSETPGSEPATSGSETPGSEPATSGSETPGSPAGSPTSTE
EGTSESATPESGPGSEPATSGSETPGSEPATSGSETPGSPAGSPTSTEEGSPAGSPTSTEEGS
PAGSPTSTEEGTSESATPESGPGSEPATSGSETPGTSTEPSEGSAPGTSTEPSEGSAPGSPAG
SPTSTEEGSPAGSPTSTEEGSPAGSPTSTEEGTSTEPSEGSAPGTSESATPESGPGTSESATPE
SGPGTSTEPSEGSAPGSTEPSEGSAPGTSTEPSEGSAPGTSESATPESGPGTSESATPESGP |
| AE1044 | 82 | GSEPATSGSETPGSEPATSGSETPGTSTEPSEGSAPGTSESATPESGPGSPAGSPTSTEEGTS
TEPSEGSAPGTSESATPESGPGTSESATPESGPGSEPATSGSETPGSEPATSGSETPGTSESA
TPESGPGTSESATPESGPGSPAGSPTSTEEGTSTEPSEGSAPGSEPATSGSETPGTSTEPSEGS
APGSPAGSPTSTEEGSPAGSPTSTEEGSPAGSPTSTEEGTSTEPSEGSAPGTSESATPESGPG
SEPATSGSETPGTSESATPESGPGTSESATPESGPGSPAGSPTSTEEGTSTEPSEGSAPGSEP
ATSGSETPGTSTEPSEGSAPGTSTEPSEGSAPGSPAGSPTSTEEGTSTEPSEGSAPGTSTEPSE
GSAPGSPAGSPTSTEEGTSTEPSEGSAPGTSESATPESGPGSPAGSPTSTEEGTSESATPESG
PGSEPATSGSETPGTSTEPSEGSAPGSEPATSGSETPGTSESATPESGPGTSTEPSEGSAPGT
SESATPESGPGTSTEPSEGSAPGTSTEPSEGSAPGSEPATSGSETPGSPAGSPTSTEEGTSES
ATPESGPGTSTEPSEGSAPGSPAGSPTSTEEGTSTEPSEGSAPGTSESATPESGPGTSTEPSE
GSAPGSEPATSGSETPGSEPATSGSETPGTSESATPESGPGTSESATPESGPGTSESATPESG
PGTSTEPSEGSAPGTSTEPSEGSAPGSPAGSPTSTEEGSPAGSPTSTEEGTSESATPESGPGSP
AGSPTSTEEGSPAGSPTSTEEGTSESATPESGPGSEPATSGSETPGTSTEPSEGSAPGSEPAT
SGSETPGSPAGSPTSTEEGTSESATPESGPGTSESATPESGPGSEPATSGSETPGTSTEPSEGS
APGTSTEPSEGSAPGSPAGSPTSTEEGTSTEPSEGSAPGTSTEPSEGSAPGSEPATSGSETPG
SPAGSPTSTEEGTSESATPESGPGTSTEPSEGSAPGSPAGSPTSTEEGTSESATPESGPGTSES
ATPESGPGTST |
| AE1140 | 83 | GSEPATSGSETPGSEPATSGSETPGTSTEPSEGSAPGSEPATSGSETPGTSESATPESGPGSE
PATSGSETPGSPAGSPTSTEEGTSESATPESGPGSEPATSGSETPGTSTEPSEGSAPGTSESA
TPESGPGTSESATPESGPGSTEPSEGSAPGTSTEPSEGSAPGSEPATSGSETPGSPAGSPTST
EEGTSTEPSEGSAPGSEPATSGSETPGSPAGSPTSTEEGTSTEPSEGSAPGTSESATPESGPG
SPAGSPTSTEEGTSTEPSEGSAPGTSESATPESGPGSEPATSGSETPGTSESATPESGPGSEP
ATSGSETPGTSTEPSEGSAPGTSTEPSEGSAPGTSTEPSEGSAPGSPAGSPTSTEEGSPAGSP
TSTEEGTSESATPESGPGTSTEPSEGSAPGTSTEPSEGSAPGSPAGSPTSTEEGSPAGSPTSTE
EGSPAGSPTSTEEGTSESATPESGPGSEPATSGSETPGTSESATPESGPGSPAGSPTSTEEGT
STEPSEGSAPGTSESATPESGPGSEPATSGSETPGSPAGSPTSTEEGTSTEPSEGSAPGTSES
ATPESGPGTSESATPESGPGSPAGSPTSTEEGTSTEPSEGSAPGSPAGSPTSTEEGSPAGSPT
STEEGTSESATPESGPGSEPATSGSETPGTSTEPSEGSAPGSEPATSGSETPGTSESATPESGP
GTSTEPSEGSAPGTSESATPESGPGTSESATPESGPGTSTEPSEGSAPGTSTEPSEGSAPGSE
PATSGSETPGTSESATPESGPGSEPATSGSETPGSPAGSPTSTEEGTSTEEGTSESA
TPESGPGSPAGSPTSTEEGTSTEPSEGSAPGSEPATSGSETPGSEPATSGSETPGSEPATSGS
ETPGTSESATPESGPGTSESATPESGPGTSTEPSEGSAPGTSTEPSEGSAPGSEPATSGSETP
GTSTEPSEGSAPGTSESATPESGPGSPAGSPTSTEEGSPAGSPTSTEEGTSTEPSEGSAPGSP
AGSPTSTEEGSPA |
| AE1236 | 84 | GSPAGSPTSTEEGTSTEPSEGSAPGSPAGSPTSTEEGTSESATPESGPGSEPATSGSETPGTS
TEPSEGSAPGTSTEPSEGSAPGTSESATPESGPGTSTEPSEGSAPGTSTEPSEGSAPGSEPAT
SGSETPGSPAGSPTSTEEGTSESATPESGPGSPAGSPTSTEEGTSTEPSEGSAPGSPAGSPTST
EEGTSTEPSEGSAPGSPAGSPTSTEEGTSTEPSEGSAPGSPAGSPTSTEEGSPAGSPTSTEEG
TSTEPSEGSAPGSEPATSGSETPGSPAGSPTSTEEGTSESATPESGPGSEPATSGSETPGSEP
ATSGSETPGTSESATPESGPGTSESATPESGPGTSTEPSEGSAPGTSTEPSEGSAPGTSESATPES
GPGSPAGSPTSTEEGTSTEPSEGSAPGSEPATSGSETPGSPAGSPTSTEEGTSTEPSEGSAPG
TSTEPSEGSAPGSPAGSPTSTEEGSPAGSPTSTEEGSPAGSPTSTEEGTSESATPESGPGSEP
ATSGSETPGTSESATPESGPGTSESATPESGPGTSTEPSEGSAPGTSESATPESGPGSPAGSP
TSTEEGTSESATPESGPGTSESATPESGPGTSTEPSEGSAPGSEPATSGSETPGTSTEPSEGS
APGSPAGSPTSTEEGTSESATPESGPGTSTEPSEGSAPGTSTEPSEGSAPGSEPATSGSETPG
SEPATSGSETPGTSESATPESGPGSEPATSGSETPGSPAGSPTSTEEGTSESATPESGPGSEP
ATSGSETPGTSTEPSEGSAPGTSESATPESGPGTSESATPESGPGTSTEPSEGSAPGSEPATS
GSETPGTSTEPSEGSAPGSPAGSPTSTEEGSPAGSPTSTEEGTSESATPESGPGSEPATSGSE
TPGSPAGSPTSTEEGSPAGSPTSTEEGTSESATPESGPGSEPATSGSETPGTSTEPSEGSAPG
TSTEPSEGSAPGSEP |
| AE1332 | 85 | GSPAGSPTSTEEGTSTEPSEGSAPGTSESATPESGPGTSESATPESGPGSEPATSGSETPGTS
TEPSEGSAPGTSESATPESGPGSPAGSPTSTEEGTSTEPSEGSAPGTSESATPESGPGSPAGS
PTSTEEGTSTEPSEGSAPGTSESATPESGPGTSTEPSEGSAPGSEPATSGSETPGSEPATSGSE
TPGSEPATSGSETPGTSESATPESGPGSPAGSPTSTEEGTSESATPESGPGSEPATSGSETPG
TSESATPESGPGSPAGSPTSTEEGTSTEPSEGSAPGTSESATPESGPGTSTE
PSEGSAPGTSTEPSEGSAPGTSTEPSEGSAPGSEPATSGSETPGTSTEPSEGSAPGSEPATP
ESGPGTSESATPESGPGTSTEPSEGSAPGTSESATPESGPGTSESATPESGPGSEPATSGSET
PGTSTEPSEGSAPGTSESATPESGPGSPAGSPTSTEEGSPAGSPTSTEEGTSTEPSEGSAPGS
EPATSGSETPGSEPATSGSETPGTSTEPSEGSAPGSEPATSGSETPGSPAGSPTSTEEGTSES
ATPESGPGSEPATSGSETPGSEPATSGSETPGTSESATPESGPGTSESATPESGPGTSTEPSE
GSAPGSPAGSPTSTEEGTSESATPESGPGTSTEPSEGSAPGSEPATSGSETPGSPAGSPTSTE |

TABLE 4-continued

XTEN Polypeptides

| XTEN Name | SEQ ID NO: | Amino Acid Sequence |
|---|---|---|
| | | EGTSTEPSEGSAPGTSTEPSEGSAPGSEPATSGSETPGTSESATPESGPGTSTEPSEGSAPGS PAGSPTSTEEGTSESATPESGPGTSESATPESGPGTSTEPSEGSAPGSEPATSGSETPGSEPA TSGSETPGTSTEPSEGSAPGTSESATPESGPGSPAGSPTSTEEGTSTEPSEGSAPGTSTEPSEG SAPGSPAGSPTSTEEGSPAGSPTSTEEGTSTEPSEGSAPGSEPATSGSETPGSPAGSPTSTEE GTSESATPESGPGSEPATSGSETPGSEPATSGSETPGTSESATPESGPGTSESATPESGPGTS TEPSEGSAPGTST |
| AE1428 | 86 | GSEPATSGSETPGSPAGSPTSTEEGTSTEPSEGSAPGSEPATSGSETPGTSESATPESGPGTS TEPSEGSAPGTSESATPESGPGSPAGSPTSTEEGTSTEPSEGSAPGTSTEPSEGSAPGSPAGS PTSTEEGTSTEPSEGSAPGTSESATPESGPGSEPATSGSETPGTSESATPESGPGSEPATSGSE TPGTSTEPSEGSAPGTSTEPSEGSAPGSEPATSGSETPGTSTEPSEGSAPGTSTEPSEGSAPG SPAGSPTSTEEGTSTEPSEGSAPGTSESATPESGPGSTEPSEGSAPGTSTE PSEGSAPGSPAGSPTSTEEGSPAGSPTSTEEGTSTEPSEGSAPGSEPATSGSETPGSPAGSPT STEEGTSTEPSEGSAPGSPAGSPTSTEEGSPAGSPTSTEEGTSESATPESGPGSEPATSGSETP GSEPATSGSETPGTSTEPSEGSAPGSPAGSPTSTEEGSPAGSPTSTEEGTSESATPESGPGSE PATSGSETPGSEPATSGSETPGTSESATPESGPGSEPATSGSETPGSEPATSGSETPGTSESA TPESGPGTSESATPESGPGTSESATPESGPGSPAGSPTSTEEGTSTEPSEGS APGTSESATPESGPGTSTEPSEGSAPGTSTEPSEGSAPGTSESATPESGPGTSTEPSEGSAPG TSESATPESGPGSPAGSPTSTEEGTSTEPSEGSAPGSEPATSGSETPGTSTEPSEGSAPGSEP ATSGSETPGTSTEPSEGSAPGTSTEPSEGSAPGSPAGSPTSTEEGTSESATPESGPGTSTEPSE GSAPGSEPATSGSETPGTSESATPESGPGTSESATPESGPGTSESATPESGPGTSTEPSEGSA PGSEPATSGSETPGSPAGSPTSTEEGTSESATPESGPGTSTEPSEGSAPGTSTEPSEGSAPGSP AGSPTSTEEGTSESATPESGPGTSTEPSEGSAPGTSTEPSEGSAPGSPAGSPTSTEEGTSESA TPESGPGSPA |
| AE1524 | 87 | GTSTEPSEGSAPGTSTEPSEGSAPGTSTEPSEGSAPGSPAGSPTSTEEGSP AGSPTSTEEGTSESATPESGPGSEPATSGSETPGTSTEPSEGSAPGTSESATPESGPGTSTEPS EGSAPGTSESATPESGPGTSESATPESGPGSPAGSPTSTEEGTSTEPSEGSAPGSEPATSGSE TPGTSTEPSEGSAPGSPAGSPTSTEEGTSTEPSEGSAPGSPAGSPTSTEEGSPAGSPTSTEEG SPAGSPTSTEEGTSESATPESGPGSEPATSGSETPGTSESATPESGPGTSESATPESGPGSPA GSPTSTEEGTSTEPSEGSAPGSEPATSGSETPGTSTEPSEGSAPGSPAGSPTSTEEGSPAGSP TSTEEGTSTEPSEGSAPGSEPATSGSETPGSPAGSPTSTEEGTSESATPESGPGSEPATSGSE TPGSPAGSPTSTEEGTSESATPESGPGTSTEPSEGSAPGSEPATSGSETPG SEPATSGSETPGTSESATPESGPGSEPATSGSETPGTSTEPSEGSAPGSPAGSPTSTEEGTSTE PSEGSAPGSEPATSGSETPGSEPATSGSETPGSPAGSPTSTEEGTSESATPESGPGTSTEPSE GSAPGSPAGSPTSTEEGSPAGSPTSTEEGTSESATPESGPGSPAGSPTSTEEGTSTEPSEGSA PGSEPATSGSETPGSEPATSGSETPGSEPATSGSETPGTSESATPESGPGTSESATPESGPGT STEPSEGSAPGTSTEPSEGSAPGSEPATSGSETPGTSTEPSEGSAPGTSESATPESGPGSPAG SPTSTEEGSPAGSPTSTEEGTSTEPSEGSAPGTSESATPESGPGSPAGSPTSTEEGTSTEPSEG SAPGSEPATSGSETPGTSESATPESGPGSEPATSGSETPGTSESATPESGPGSEPATSGSETP GSEPATSGSETPGTSTEPSEGSAPGTSESATPESGPGTSTEPSEGSAPGTSTEPSEGSAPGTS ESATPESGPGSPA |
| AE1620 | 88 | GSEPATSGSETPGTSTEPSEGSAPGSEPATSGSETPGTSTEPSEGSAPGTSESATPESGPGTS ESATPESGPGSEPATSGSETPGTSTEPSEGSAPGTSTEPSEGSAPGTSESATPESGPGTSTEPS EGSAPGTSTEPSEGSAPGSEPATSGSETPGSPAGSPTSTEEGTSESATPESGPGTSESATPES GPGTSTEPSEGSAPGTSESATPESGPGSEPATSGSETPGTSESATPESGPGTSESATPESGPG TSTEPSEGSAPGTSTEPSEGSAPGSEPATSGSETPGSPAGSPTSTEEGTSESATPESGPGSEP ATSGSETPGSEPATSGSETPGTSESATPESGPGSPAGSPTSTEEGTSTEEGTSTEEGTSTEEGT GSAPGTSESATPESGPGTSTEPSEGSAPGTSTEPSEGSAPGTSESATPESGPGTSTEPSEGSA PGSPAGSPAGSPTSTEEGSPAGSPTSTEEGTSESATPESGPGSEPATSGSETPGSEPATSGSETPGT STEPSEGSAPGTSESATPESGPGSPAGSPTSTEEGSPAGSPTSTEEGTSTEPSEGSAPGSPAG SPTSTEEGSPAGSPTSTEEGTSESATPESGPGSEPATSGSETPGTSTEPSEGSAPGTSTEPSEG SAPGSEPATSGSETPGSPAGSPTSTEEGTSESATPESGPGSPAGSPTSTEEGTSTEPSEGSAP GTSESATPESGPGSEPATSGSETPGTSESATPESGPGTSESATPESGPGSPAGSPTSTEEGTS TEPSEGSAPGSEPATSGSETPGSPAGSPTSTEEGTSTEPSEGSAPGSEPATSGSETPGSEPAT SGSETPGTSESATPESGPGTSESATPESGPGTSTEPSEGSAPGTSESATPESGPGSEPATSGS ETPGTSESATPESGPGTSTEPSEGSAPGTSESATPESGPGSEPATSGSETP GTSTEPSEGSAPGSPAGSPTSTEEGTSESATPESGPGTSTEPSEGSAPGTSTEPSEGSAPGSP AGSPTSTEEGTST |
| AE1716 | 89 | GTSESATPESGPGTSTEPSEGSAPGTSESATPESGPGTSTEPSEGSAPGSEPATSGSETPGSP AGSPTSTEEGTSESATPESGPGSEPATSGSETPGSEPATSGSETPGTSESATPESGPGTSESA TPESGPGTSTEPSEGSAPGSEPATSGSETPGSEPATSGSETPGTSESATPESGPGTSESATPES GPGSEPATSGSETPGTSESATPESGPGSPAGSPTSTEEGSPAGSPTSTEEGTSTEPSEGSAPG SEPATSGSETPGSPAGSPTSTEEGTSESATPESGPGSPAGSPTSTEEGTSTEPSEGSAPGSEP ATSGSETPGSPAGSPTSTEEGTSESATPESGPGSPAGSPTSTEEGSPAGSPTSTEEGTSTEPSE GSAPGSEPATSGSETPGSPAGSPTSTEEGTSESATPESGPGTSTEPSEGSAPGSPAGSPTSTE EGTSESATPESGPGSEPATSGSETPGTSTEPSEGSAPGSPAGSPTSTEEGTSTEPSEGSAPGT SESATPESGPGTSESATPESGPGTSTEPSEGSAPGSEPATSGSETPGTSES ATPESGPGTSESATPESGPGTSTEPSEGSAPGTSTEPSEGSAPGSPAGSPTSTEEGSPAGSPT STEEGTSTEPSEGSAPGSEPATSGSETPGSEPATSGSETPGTSESATPESGPGSPAGSPTSTEE GTSESATPESGPGTSTEPSEGSAPGTSTEPSEGSAPGSPAGSPTSTEEGSPAGSPTSTEEGTS ESATPESGPGSPAGSPTSTEEGTSTEPSEGSAPGSEPATSGSETPGSPAGSPTSTEEGSPAGS PTSTEEGTSTEPSEGSAPGTSESATPESGPGTSESATPESGPGSPAGSPTSTEEGTSTEPSEGS |

TABLE 4-continued

XTEN Polypeptides

| XTEN Name | SEQ ID NO: | Amino Acid Sequence |
|---|---|---|
| | | APGSPAGSPTSTEEGTSTEPSEGSAPGSPAGSPTSTEEGTSTEPSEGSAPGTSTEPSEGSAPG SEPATSGSETPGSPAGSPTSTEEGTSESATPESGPGSEPATSGSETPGSPAGSPTSTEEGTSES ATPESGPGTSE |
| AE1812 | 90 | GTSESATPESGPGSPAGSPTSTEEGSPAGSPTSTEEGTSESATPESGPGSEPATSGSETPGTS TEPSEGSAPGTSTEPSEGSAPGTSTEPSEGSAPGSPAGSPTSTEEGTSTEPSEGSAPGTSESA TPESGPGTSESATPESGPGSPAGSPTSTEEGSPAGSPTSTEEGSPAGSPTSTEEGTSESATPES GPGSEPATSGSETPGTSESATPESGPGTSTEPSEGSAPGTSTEPSEGSAPG TSTEPSEGSAPGTSESATPESGPGSPAGSPTSTEEGTSESATPESGPGTSTEPSEGSAPGSPA GSPTSTEEGTSESATPESGPGSEPATSGSETPGTSTEPSEGSAPGSEPATSGSETPGSEPATS GSETPGTSESATPESGPGTSESATPESGPGTSTEPSEGSAPGTSESATPESGPGSPAGSPTST EEGTSTEPSEGSAPGSEPATSGSETPGTSESATPESGPGSTEPSEGSAPG TSESATPESGPGSPAGSPTSTEEGSPAGSPTSTEEGSPAGSPTSTEEGTSESATPESGPGSEP ATSGSETPGTSESATPESGPGTSESATPESGPGSEPATSGSETPGTSTEPSEGSAPGTSTEPSE GSAPGTSTEPSEGSAPGTSESATPESGPGSEPATSGSETPGTSESATPESGPGSEPATSGSET PGTSTEPSEGSAPGSEPATSGSETPGSPAGSPTSTEEGTSTEPSEGPGTSESATPESGPGT SESATPESGPGSPAGSPTSTEEGTSTEPSEGSAPGTSESATPESGPGTSESATPESGPGTSTEP SEGSAPGTSTEPSEGSAPGSPAGSPTSTEEGTSESATPESGPGSEPATSGSETPGTSESATPE SGPGTSESATPESGPGTSTEPSEGSAPGSEPATSGSETPGTSESATPESGPGSPAGSPTSTEE GTSTEPSEGSAPGSEPATSGSETPGSPAGSPTSTEEGTSESATPESGPGSPAGSPTSTEEGTS TEPSEGSAPGSEP |
| AE1908 | 91 | GSEPATSGSETPGTSTEPSEGSAPGTSESATPESGPGSEPATSGSETPGTSTEPSEGSAPGSP AGSPTSTEEGTSESATPESGPGSPAGSPTSTEEGTSTEPSEGSAPGSEPATSGSETPGTSTEPS EGSAPGTSESATPESGPGSEPATSGSETPGSEPATSGSETPGTSESATPESGPGTSTEPSEGS APGTSESATPESGPGTSESATPESGPGSPAGSPTSTEEGSPAGSPTSTEEGTSESATPESGPG TSESATPESGPGTSTEPSEGSAPGTSTEPSEGSAPGSPAGSPTSTEEGTSTEPSEGSAPGSEP ATSGSETPGSEPATSGSETPGSEPATSGSETPGTSESATPESGPGTSESAT PESGPGTSESATPESGPGTSTEPSEGSAPGTSESATPESGPGTSESATPESGPGTSTEPSEGS APGSPAGSPTSTEEGTSTEPSEGSAPGSEPATSGSETPGSPAGSPTSTEEGTSESATPESGPG TSTEPSEGSAPGSEPATSGSETPGTSESATPESGPGTSESATPESGPGTSTEPSEGSAPGSEP ATSGSETPGSPAGSPTSTEEGTSESATPESGPGTSESATPESGPGTSTEPSEGSAPGSEPATS GSETPGSPAGSPTSTEEGTSESATPESGPGSEPATSGSETPGTSTEPSEGSAPGSEPATSGSE TPGSPAGSPTSTEEGTSESATPESGPGTSTEPSEGSAPGSEPATSGSETPGTSESATPESGPG TSESATPESGPGSPAGSPTSTEEGTSTEPSEGSAPGSPAGSPTSTEEGSPAGSPTSTEEGSPA GSPTSTEEGTSESATPESGPGSEPATSGSETPGTSTEPSEGSAPGTSTEPSEGSAPGTSESATP ESGPGTSTEPSEGSAPGTSESATPESGPGSEPATSGSETPGTSTEPSEGSAPGTSESATPESG PGSPAGSPTSTEEGSPAGSPTSTEEGTSESATPESGPGSPAGSPTSTEEGT SESATPESGPGSEP |
| AE2004A | 92 | GTSTEPSEGSAPGSEPATSGSETPGTSTEPSEGSAPGTSTEPSEGSAPGSEPATSGSETPGSP AGSPTSTEEGSPAGSPTSTEEGTSESATPESGPGSEPATSGSETPGTSTEPSEGSAPGTSTEPS EGSAPGSPAGSPTSTEEGTSESATPESGPGTSESATPESGPGSPAGSPTSTEEGTSTEPSEGS APGTSESATPESGPGTSTEPSEGSAPGSEPATSGSETPGTSESATPESGPGSEPATSGSETPG TSTEPSEGSAPGTSTEPSEGSAPGSPAGSPTSTEEGSPAGSPTSTEEGTSESATPESGPGSPA GSPTSTEEGTSTEPSEGSAPGSEPATSGSETPGSEPATSGSETPGSPAGSPTSTEEGTSESATP ESGPGTSTEPSEGSAPGSEPATSGSETPGTSESATPESGPGSEPATSGSETPGSPAGSPTSTE EGTSESATPESGPGTSESATPESGPGSEPATSGSETPGTSESATPESGPGTSESATPESGPGT SESATPESGPGTSTEPSEGSAPGTSESATPESGPGSEPATSGSETPGTSTEPSEGSAPGSPAG SPTSTEEGTSTEPSEGSAPGSEPATSGSETPGSPAGSPTSTEEGTSESATPESGPGTSESATPE SGPGTSTEPSEGSAPGTSESATPESGPGTSTEPSEGSAPGTSESATPESGPGSEPATSGSETP GTSTEPSEGSAPGTSTEPSEGSAPGSPAGSPTSTEEGSPAGSPTSTEEGTSESATPESGPGTS TEPSEGSAPGTSESATPESGPGSPAGSPTSTEEGSPAGSPTSTEEGSPAGSPTSTEEGTSTEPS EGSAPGSPAGSPTSTEEGSPAGSPTSTEEGTSESATPESGPGSEPATSGSETPGSEPATSGSE TPGTSESATPESGPGSEPATSGSETPGTSESATPESGPGTSTEPSEGSAPGTSTEPDEGSAPG SPAGSPTSTEEGSPAGSPTSTEEGTSESATPESGPGSPAGSPTSTEEGTSTEPSEGSAPGTSES ATPESGPGTSE |
| AG948 | 93 | GSSTPSGATGSPGTPGSGTASSSPGASPGTSSTGSPGSSPSASTGTGPGTPGSGTASSSPGTP GSGTASSSPGTPGSGTASSSPGSSPSASTGTGPGASPGTSSTGSPGSSTPS GATGSPGSSTPSGATGSPGSSPSASTGTGPGSSTPSGATGSPGASPGTSSTGSPGASPGTSST GSPGSSPSASTGTGPGSSPSASTGTGPGASPGTSSTGSPGTPGSGTASSSPGTPGSGTASSSPG SSPSASTGTGPGASPGTSSTGSPGTPGSGTASSSPGTPGSGTASSSPGSSTPSGATGSPGSS TPSGATGSPGASPGTSSTGSPGSSPSASTGTGPGASPGTSSTGSPGASPGT SSTGSPGSSTPSGATGSPGSSPSASTGTGPGSSPSASTGTGPGTPGSGTASSSPGASPGTSST GSPGTPGSGTASSSPGSSTPSGATGSPGSSTPSGATGSPGASPGTSSTGSPGTPGSGTASSSP GSSTPSGATGSPGASPGTSSTGSPGTPGSGTASSSPGSSPSASTGTGPGASPGTSSTGSPGAS PGTSSTGSPGTPGSGTASSSPGTPGSGTASSSPGSSPSASTGTGPGASPGTSSTGSPGASPGT SSTGSPGTPGSGTASSSPGTPGSGTASSSPGSSPSASTGTGPGSSTPSGATGSPGSSTGP GSSTPSGATGSPGSSPSASTGTGPGSSPSASTGTGPGTPGSGTASSSPGSSTPSGATGSPGAS PGTSSTGSPGTPGSGTASSSPGTPGSGTASSSPGSSTPSGATGSPGTPGSGTASSSPGASPGT SSTGSPGSSTPSGATGSPGSSTPSGATGSPGTPGSGTASSSPGSSTPSGATGSPGSSTPSGAT GSP |

TABLE 4-continued

XTEN Polypeptides

| XTEN Name | SEQ ID NO: | Amino Acid Sequence |
|---|---|---|
| AG1044 | 94 | GTPGSGTASSSPGTPGSGTASSSPGSSPSASTGTGPGTPGSGTASSSPGASPGTSSTGSPGTP<br>GSGTASSSPGSSPSASTGTGPGSSTPSGATGSPGASPGTSSTGSPGASPGTSSTGSPGSSPSA<br>STGTGPGSSTPSGATGSPGSSPSASTGTGPGSSPSASTGTGPGTPGSGTASSSPGTPGSGTAS<br>SSPGASPGTAATGSPGSSTPSGATGSPGSSPSASTGTGPGTPGSGTASSSPGASPGTSSTGSP<br>GTPGSGTASSSPGSSPSASTGTGPGSSPSASTGTGPGASPGTSSTGSPGASPGTSSTGSPGSS<br>TPSGATGSPGSSTPSGATGSPGTPGSGTASSSPGSSPSASTGTGPGSSTPSGATGSPGASPGT<br>SSTGSPGSSTPSGATGSPGSSTPSGATGSPGSSPSASTGTGPGASPGTSSRGSPGTPGSGTAS<br>SSPGASPGTSSTGSPGSSPSASTGTGPGTPGSGTASSSPGASPGTSSTGSPGASPGTSSTGSP<br>GSSTPSGATGSPGTPGSGTASSSPGSSTPSGATGSPGASPGTSSTGSPGTPGSGTASSSPGTP<br>GSGTASSSPGSSTPSGATGSPGSSTPSGATGSPGTPGSGTASSSPGSSTPSGATGSPGSSTPS<br>GATGSPGASPGTSSTGSPGSSPSASTGTGPGSSPSASTGTGPGASPGTSSTGSPGASPGTSST<br>GSPGTPGSGTASSSPGSSPSASTGTGPGTPGSGTASSSPGSSTPSGATGSPGSSTPSGATGSP<br>GASPGTSSTGSPGSSPSASTGTGPGASPGTSSTGSPGSSPSASTGTGPGSSPSASTGTGPGAS<br>PGTSSTGSPGASPGTSSTGSPGSSTPSGATGSPGASPGTSSTGSPGASPGTSSTGSPGTPGSG<br>TASSSPGTPGSGTASSSPGTPGSGTASSSPGSSTPSGATGSPGSSTPSGATGSPGSSPSASTG<br>TGPGSSPSASTGTGPGTPGSGTASSSPGSSPSASTGTGPGASPGTSSTGSPGSSTPSGATGSP<br>GTPGSGTASSSPGSST |
| AG1140 | 95 | GASPGTSSTGSPGSSPSASTGTGPGSSTPSGATGSPGASPGTSSTGSPGASPGTSSTGSPGSS<br>TPSGATGSPGTPGSGTASSSPGASPGTSSTGSPGTPGSGTASSSPGSSTPS<br>GATGSPGSSTPSGATGSPGTPGSGTASSSPGSSTPSGATGSPGSSTPSGATGSPGSSPSASTG<br>TGPGSSPSASTGTGPGASPGTSSTGSPGTPGSGTASSSPGASPGTSSTGSPGSSTPSGATGSP<br>GTPGSGTASSSPGSSPSASTGTGPGSSTPSGATGSPGSSPSASTGTGPGSSTPSGATGSPGAS<br>PGTSSTGSPGSSPSASTGTGPGTPGSGTASSSPGASPGTSSTGSPGSSTPSGATGSPGASPGT<br>SSTGSPGSSPSASTGTGPGTPGSGTASSSPGTPGSGTASSSPGASPGTSSTGSPGTPGSGTAS<br>SSPGTPGSGTASSSPGSSPSASTGTGPGASPGTSSTGSPGSSTPSGATGSPGASPGTSSTGSP<br>GSSPSASTGTGPGTPGSGTASSSPGSSPSASTGTGPGSSPSASTGTGPGASPGTSSTGSPGAS<br>PGTSSTGSPGTPGSGTASSSPGASPGTSSTGSPGASPGTSSTGSPGTPGSGTASSSPGTPGSG<br>TASSSPGSSTPSGATGSPGSSTPSGATGSPGTPGSGTASSSPGSSPSASTGTGPGTPGSGTAS<br>SSPGSSTPSGATGSPGSSTPSGATGSPGASPGTSSTGSPGTPGSGTASSSPGASPGTSSTGSP<br>GSSTPSGATGSPGSSTPSGATGSPGTPGSGTASSSPGSSTPSGATGSPGSSTPSGATGSPGAS<br>PGTSSTGSPGSSPSASTGTGPGSSTPSGATGSPGSSTPSGATGSPGSSPSASTGTGPGSSSPA<br>STGTGPGSSTPSGATGSPGASPGTSSTGSPGSSPSASTGTGPGTPGSGTASSSPGASPGTSST<br>GSPGSSPSASTGTGPGASPGTSSTGSPGSSTPSGATGSPGSSPSASTGTGPGSSPSASTGTGP<br>GASPGTSSTGSPGSST |
| AG1236 | 96 | GSSPSASTGTGPGTPGSGTASSSPGSSPSASTGTGPGSSPSASTGTGPGTPGSGTASSSPGAS<br>PGTSSTGSPGSSTPSGATGSPGTPGSGTASSSPGASPGTSSTGSPGTPGSGTASSSPGTPGSG<br>TASSSPGSSPSASTGTGPGSSPSASTGTGPGSSTPSGATGSPGASPGTSSTGSPGSSPSASTG<br>TGPGTPGSGTASSSPGTPGSGTASSSPGSSTPSGATGSPGASPGTSSTGSPGSSPSASTGTGP<br>GTPGSGTASSSPGTPGSGTASSSPGASPGTSSTGSPGSSTPSGATGSPGSSTPSGATGSPGSS<br>PSASTGTGPGSSPSASTGTGPGASPGTSSTGSPGSSPSASTGTGPGSSTPSGATGSPGASPGT<br>SSTGSPGASPGTSSTGSPGSSTPSGATGSPGSSPSASTGTGPGASPGTSSTGSPGASPGTSST<br>GSPGTPGSGTASSSPGSSTPSGATGSPGASPGTSSTGSPGSSTPSGATGSPGTPGSGTASSSP<br>GSSPSASTGTGPGSSTPSGATGSPGTPGSGTASSSPGASPGTSSTGSPGSSTPSGATGSPGAS<br>PGTSSTGSPGSSPSASTGTGPGSSPSASTGTGPGASPGTSSTGSPGSSPSASTGTGPGTPGSG<br>TASSSPGTPGSGTASSSPGASPGTSSTGSPGTPGSGTASSSPGASPGTSSTGSPGTPGSGTAS<br>SSPGASPGTSSTGSPGSSTPSGATGSPGASPGTSSTGSPGSSPSASTGTGPGTPGSGTASSSP<br>GTPGSGTASSSPGSSPSASTGTGPGTPGSGTASSSPGASPGTSSTGSPGSSTPSGATGSPGTP<br>GSGTASSSPGASPGTSSTGSPGTPGSGTASSSPGTPGSGTASSSPGSSTPSGATGSPGTPGSG<br>TASSSPGSSPSASTGTGPGSSTPSGATGSPGTPGSGTASSSPGSSTPSGATGSPGSSTPSGAT<br>GSPGSSPSASTGTGPGASPGTSSTGSPGTPGSGTASSSPGSSPSASTGTGPGSSPSASTGTGP<br>GASPGTSSTGSPGASP |
| AG1332 | 97 | GSSTPSGATGSPGSSPSASTGTGPGTPGSGTASSSPGSSPSASTGTGPGASPGTSSTGSPGSS<br>PSASTGTGPGTPGSGTASSSPGASPGTSSTGSPGSSTPSGATGSPGSSPSASTGTGPGSSTPS<br>GATGSPGASPGTSSTGSPGTPGSGTASSSPGASPGTSSTGSPGSSTPSGATGSPGSSTPSGAT<br>GSPGSSPSASTGTGPGTPGSGTASSSPGSSTPSGATGSPGSSTPSGATGSPGSSPSASTGTGP<br>GTPGSGTASSSPGASPGTSSTGSPGTPGSGTASSSPGASPGTSSTGSPGASPGTSSTGSPGTP<br>GSGTASSSPGTPGSGTASSSPGSSTPSGATGSPGSSTPSGATGSPGSSTPSGATGSPGASPGT<br>SSTGSPGSSPSASTGTGPGSSTPSGATGSPGSSPSASTGTGPGSSTPSGATGSPGTPGSGTAS<br>SSPGSSPSASTGTGPGSSTPSGATGSPGASPGTSSTGSPGSSPSASTGTGPGSSSPSASTGTGP<br>GASPGTSSTGSPGSSTPSGATGSPGASPGTSSTGSPGTPGSGTASSSPGTPGSGTASSSPGSS<br>PSASTGTGPGTPGSGTASSSPGSSTPSGATGSPGSSPSASTGTGPGSSTPSGATGSPGTPGSG<br>TASSSPGTPGSGTASSSPGSSPSASTGTGPGSSTPSGATGSPGSSTPSGATGSPGSSPSASTG<br>TGPGSSPSASTGTGPGASPGTSSTGSPGASPGTSSTGSPGASPGTSSTGSPGASPGTSSTGSP<br>GSSPSASTGTGPGTPGSGTASSSPGASPGTSSTGSPGASPGTSSTGSPGTPGSGTASSSPGTP<br>GSGTASSSPGSSPSASTGTGPGTPGSGTASSSPGASPGTSSTGSPGSSTPSGATGSPGTPGSG<br>TASSSPGTPGSGTASSSPGSSTPSGATGSPGSSTPSGATGSPGTPGSGTASSSPGSSPSASTG<br>TGPGSSPSASTGTGPGASPGTSSTGSPGSSPSASTGTGPGSSPSASTGTGPGASPGTSSTGSP<br>GASPGTSSTGSPGTPG |
| AG1428 | 98 | GTPGSGTASSSPGSSTPSGATGSPGASPGTSSTGSPGSSTPSGATGSPGTPGSGTASSSPGTP<br>GSGTASSSPGSSTPSGATGSPGSSTPSGATGSPGASPGTSSTGSPGSSPSASTGTGPGSSTPS<br>GATGSPGASPGTSSTGSPGSSPSASTGTGPGTPGSGTASSSPGASPGTSSTGSPGASPGTSST |

TABLE 4-continued

XTEN Polypeptides

| XTEN Name | SEQ ID NO: | Amino Acid Sequence |
|---|---|---|
| | | GSPGTPGSGTASSSPGTPGSGTASSSPGASPGTSSTGSPGASPGTSSTGSPGTPGSGTASSSP
GTPGSGTASSSPGSSPSASTGTPGSSPSASTGTPGASPGTSSTGSPGSSPSASTGTGPGSS
PSASTGTGPGASPGTSSTGSPGASPGTSSTGSPGTPGSGTASSSPGTPGSGTASSSPGSSPSA
STGTGPGASPGTSSTGSPGSSTPSGATGSPGASPGTSSTGSPGSSPSASTGTGPGSSTPSGAT
GSPGSSPSASTGTGPGSSPSASTGTGPGASPGTSSTGSPGSSPSASTGTGPGSSPSASTGTGP
GASPGTSSTGSPGASPGTSSTGSPGSSPSASTGTGPGTPGSGTASSSPGASPGTSSTGSPGSS
TPSGATGSPGTPGSGTASSSPGTPGSGTASSSPGSSPSASTGTGPGSSTPSGATGSPGASPGT
SSTGSPGASPGTSSTGSPGSSTPSGATGSPGSSPSASTGTGPGASPGTSSTGSPGSSTPSGAT
GSPGTPGSGTASSSPGASPGTSSTGSPGTPGSGTASSSPGASPGTSSTGSPGSSTPSGATGSP
GSSTPSGATGSPGASPGTSSTGSPGSSPSASTGTGPGTPGSGTASSSPGTPGSGTASSSPGSS
TPSGATGSPGTPGSGTASSSPGASPGTSSTGSPGSSTPSGATGSPGTPGSGTASSSPGSSPSA
STGTGPGSSTPSGATGSPGSSPSASTGTGPGSSTPSGATGSPGTPGSGTAS
SSPGSSPSASTGTPGPGSGTASSSPGSSTPSGATGSPGSSPSASTGTGPGSSPSASTGTGP
GTPGSGTASSSPGASP |
| AG1524 | 99 | GSSTPSGATGSPGTPGSGTASSSPGTPGSGTASSSPGASPGTSSTGSPGSSTPSGATGSPGTP
GSGTASSSPGSSTPSGATGSPGSSPSASTGTGPGSSTPSGATGSPGTPGSGTASSSPGTPGSG
TASSSPGSSPSASTGTGPGSSTPSGATGSPGSSPSASTGTGPGTPGSGTASSSPGASPGTSST
GSPGSSTPSGATGSPGASPGTSSTGSPGTPGSGTASSSPGSSTPSGATGSPGTPGSGTASSSP
GSSPSASTGTGPGASPGTSSTGSPGASPGTSSTGSPGTPGSGTASSSPGSSTPSGATGSPGSS
TPSGATGSPGSSPSASTGTGPGSSPSASTGTGPGASPGTSSTGSPGTPGSGTASSSPGTPGSG
TASSSPGSSPSASTGTGPGASPGTSSTGSPGASPGTSSTGSPGTPGSGTASSSPGSSPSASTG
TGPGASPGTSSTGSPGASPGTSSTGSPGSSTPSGATGSPGSSPSASTGTGPGSSPSASTGTGP
GTPGSGTASSSPGTPGSGTASSSPGASPGTSSTGSPGSSTPSGATGSPGTPGSGTASSSPGAS
PGTSSTGSPGTPGSGTASSSPGTPGSGTASSSPGSSTPSGATGSPGSSTPSGATGSPGTPGSG
TASSSPGSSPSASTGTGPGSSTPSGATGSPGSSTPSGATGSPGSSPSASTGTGPGTPGSGTAS
SSPGSSPSASTGTGPGASPGTSSTGSPGSSPSASTGTGPGTPGSGTASSSPGASPGTSSTGSP
GASPGTSSTGSPGTPGSGTASSSPGTPGSGTASSSPGSSTPSGATGSPGTPGSGTASSSPGAS
PGTSSTGSPGSSTPSGATGSPGSSTPSGATGSPGSSTPSGATGSPGTPGSGTASSSPGSSPSA
STGTGPGSSPSASTGTGPGSSPSASTGTGPGASPGTSSTGSPGASPGTSSTGSPGSSPSASTG
TGPGTPGSGTASSSPGASPGTSSTGSPGSSTPSGATGSPGASPGTSSTGSPGASPGTSSTGSP
GSSTPSGATGSPGTPG |
| AG1620 | 100 | GSSTPSGATGSPGSSTPSGATGSPGTPGSGTASSSPGSSPSASTGTGPGTPGSGTASSSPGAS
PGTSSTGSPGSSTPSGATGSPGASPGTSSTGSPGTPGSGTASSSPGASPGTSSTGSPGSSPSA
STGTGPGTPGSGTASSSPGASPGTSSTGSPGSSTPSGATGSPGSSPSASTGTGPGSSTPSGAT
GSPGASPGTSSTGSPGASPGTSSTGSPGASPGTSSTGSPGSSTPSGATGSPGASPGTSSTGSP
GTPGSGTASSSPGSSTPSGATGSPGSSTPSGATGSPGSSPSASTGTGPGSSPSASTGTGPGSS
TPSGATGSPGSSPSASTGTGPGSSPSASTGTGPGASPGTSSTGSPGASPGTSSTGSPGTPGSG
TASSSPGSSPSASTGTGPGSSPSASTGTGPGASPGTSSTGSPGSSPSASTGTGPGTPGSGTAS
SSPGSSPSASTGTGPGSSTPSGATGSPGASPGTSSTGSPGTPGSGTASSSP
GSSPSASTGTGPGASPGTSSTGSPGSSTPSGATGSPGASPGTSSTGSPGASPGTSSTGSPGTP
GSGTASSSPGASPGTSSTGSPGASPGTSSTGSPGSSTPSGATGSPGTPGSGTASSSPGSSPSA
STGTGPGSSTPSGATGSPGTPGSGTASSSPGSSTPSGATGSPGSSTPSGATGSPGSSPSASTG
TGPGSSPSASTGTGPGSSTPSGATGSPGASPGTSSTGSPGSSTPSGATGSPGTPGSGTASSSP
GASPGTSSTGSPGSSPSASTGTGPGSSTPSGATGSPGSSPSASTGTGPGSSTPSGATGSPGSS
PSASTGTPGPGSGTASSSPGTPGSGTASSSPGSSTPSGATGSPGSSTPSGATGSPGTPGSG
TASSSPGSSPSASTGTGPGSSTPSGATGSPGSSPSASTGTGPGSSPSASTGTGPGSSTPSGAT
GSPGASPGTSSTGSPGASPGTSSTGSPGTPGSGTASSSPGTPGSGTASSSPGTPGSGTASSSP
GSSTPSGATGSPGSST |
| AG1716 | 101 | GASPGTSSTGSPGSSPSASTGTGPGSSTPSGATGSPGSSPSASTGTGPGTPGSGTASSSPGSS
TPSGATGSPGSSTPSGATGSPGSSPSASTGTGPGSSTPSGATGSPGTPGSGTASSSPGSSPSA
STGTGPGSSTPSGATGSPGASPGTSSTGSPGSSPSASTGTGPGSSPSASTGTGPGTPGSGTAS
SSPGASPGTSSTGSPGSSTPSGATGSPGSSPSASTGTGPGASPGTSSTGSPGSSTPSGATGSP
GTPGSGTASSSPGSSPSASTGTGPGSSPSASTGTGPGSSPSASTGTGPGTPGSGTASSSPGTP
GSGTASSSPGSSTPSGATGSPGTPGSGTASSSPGSSPSASTGTGPGASPGTSSTGSPGASPGT
SSTGSPGTPGSGTASSSPGSSPSASTGTGPGASPGTSSTGSPGSSTPSGAT
GSPGSSTPSGATGSPGASPGTSSTGSPGTPGSGTASSSPGSSPSASTGTGPGTPGSGTASSSP
GASPGTSSTGSPGSSTPSGATGSPGASPGTSSTGSPGASPGTSSTGSPGTPGSGTASSSPGTP
GSGTASSSPGSSPSASTGTGPGSSPSASTGTGPGSSPSASTGTGPGTPGSGTASSSPGASPGT
SSTGSPGSSTPSGATGSPGASPGTSSTGSPGSSPSASTGTGPGSSPSASTG
TGPGASPGTSSTGSPGSSPSASTGTGPGSSPSASTGTGPGTPGSGTASSSPGASPGTSSTGSP
GTPGSGTASSSPGTPGSGTASSSPGASPGTSSTGSPGSSTPSGATGSPGSSTPSGATGSPGSS
PSASTGTGPGSSTPSGATGSPGTPGSGTASSSPGSSPSASTGTGPGSSTPSGATGSPGSSTPS
GATGSPGSSPSASTGTGPGSSPSASTGTPGPGSGTASSSPGSSPSASTG
TGPGSSTPSGATGSPGASPGTSSTGSPGASPGTSSTGSPGSSPSASTGTGPGASPGTSSTGSP
GASPGTSSTGSPGTPG |
| AG1812 | 102 | GSSTPSGATGSPGSSPSASTGTPGASPGTSSTGSPGASPGTSSTGSPGTPGSGTASSSPGSS
PSASTGTPGASPGTSSTGSPGSSTPSGATGSPGSSTPSGATGSPGASPGTSSTGSPGSSPSA
STGTGPGTPGSGTASSSPGTPGSGTASSSPGASPGTSSTGSPGSSTPSGATGSPGSSTPSGAT
GSPGSSPSASTGTGPGTPGSGTASSSPGASPGTSSTGSPGSSTPSGATGSPGTPGSGTASSSP
GSSPSASTGTGPGSSTPSGATGSPGTPGSGTASSSPGSSPSASTGTGPGTPGSGTASSSPGAS
PGTSSTGSPGSSTPSGATGSPGSSTPSGATGSPGTPGSGTASSSPGSSTPSGATGSPGSSTPS |

TABLE 4-continued

XTEN Polypeptides

| XTEN Name | SEQ ID NO: | Amino Acid Sequence |
|---|---|---|
| | | GATGSPGASPGTSSTGSPGASPGTSSTGSPGASPGTSSTGSPGSSTPSGATGSPGTPGSGTA<br>SSSPGSSPSASTGTGPGTPGSGTASSSPGASPGTSSTGSPGTPGSGTASSSPGASPGTSSTGS<br>PGSSTPSGATGSPGSSPSASTGTGPGSSPSASTGTGPGTPGSGTASSSPGASPGTSSTGSPGA<br>SPGTSSTGSPGTPGSGTASSSPGASPGTSSTGSPGSSTPSGATGSPGSSTPSGATGSPGSSPS<br>ASTGTGPGASPGTSSTGSPGASPGTSSTGSPGTPGSGTASSSPGTPGSGTASSSPGSSTPSGA<br>TGSPGSSPSASTGTGPGSSPSASTGTGPGASPGTSSTGSPGASPGTSSTGSPGSSTPSGATGS<br>PGSSPSASTGTGPGASPGTSSTGSPGSSTPSGATGSPGTPGSGTASSSPGSSPSASTGTGPGA<br>SPGTSSTGSPGSSTPSGATGSPGTPGSGTASSSPGSSTPSGATGSPGSSTPSGATGSPGSSTPS<br>GATGSPGSSPSASTGTGPGSSPSASTGTGPGSSTPSGATGSPGSSPSASTGTGPGSSPSASTG<br>TGPGSSTPSGATGSPGASPGTSSTGSPGASPGTSSTGSPGTPGSGTASSSPGASPGTSSTGSP<br>GSSTPSGATGSPGASP |
| AG1908 | 103 | GSSPSASTGTGPGSSPSASTGTGPGSSPSASTGTGPGTPGSGTASSSPGSSPSASTGTGPGSS<br>PSASTGTGPGASPGTSSTGSPGSSPSASTGTGPGTPGSGTASSSPGTPGSGTASSSPGASPGT<br>SSTGSPGTPGSGTASSSPGTPGSGTASSSPGSSPSASTGTGPGSSTPSGATGSPGSSPSASTG<br>TGPGASPGTSSTGSPGSSPSASTGTGPGASPGTSSTGSPGTPGSGTASSSP<br>GTPGSGTASSSPGASPGTSSTGSPGTPGSGTASSSPGTPGSGTASSSPGSSPSASTGTGPGSS<br>TPSGATGSPGASPGTSSTGSPGSSTPSGATGSPGSSPSASTGTGPGSSPSASTGTGPGSSTPS<br>GATGSPGASPGTSSTGSPGSSPSASTGTGPGTPGSGTASSSPGASPGTSSTGSPGASPGTSST<br>GSPGTPGSGTASSSPGTPGSGTASSSPGSSTPSGATGSPGTPGSGTASSSPGASPGTSSTGSP<br>GSSTPSGATGSPGTPGSGTASSSPGSSPSASTGTGPGSSPSASTGTGPGSSTPSGATGSPGAS<br>PGTSSTGSPGASPGTSSTGSPGTPGSGTASSSPGTPGSGTASSSPGSSTPSGATGSPGSSPSA<br>STGTGPGSSPSASTGTGPGASPGTSSTGSPGASPGTSSTGSPGSSTPSGATGSPGASPGTSST<br>GSPGASPGTSSTGSPGTPGSGTASSSPGTPGSGTASSSPGTPGSGTASSSPGSSTPSGATGSP<br>GSSTPSGATGSPGSSPSASTGTGPGSSPSASTGTGPGSSTPSGATGSPGTPGSGTASSSPGSS<br>PSASTGTGPGASPGTSSTGSPGSSTPSGATGSPGSSPSASTGTGPGSSTPSGATGSPGASPGT<br>SSTGSPGSSPSASTGTGPGTPGSGTASSSPGSSPSASTGTGPGSSTPSGATGSPGASPGTSST<br>GSPGSSPSASTGTGPGTPGSGTASSSPGSSTPSGATGSPGSSTPSGATGSPGASPGTSSTGSP<br>GSSPSASTGTGPGSSP |
| AG2004A | 104 | GSSPSASTGTGPGTPGSGTASSSPGSSTPSGATGSPGTPGSGTASSSPGSSTPSGATGSPGSS<br>TPSGATGSPGSSPSASTGTGPGSSPSASTGTGPGSSPSASTGTGPGTPGSGTASSSPGASPGT<br>SSTGSPGSSTPSGATGSPGTPGSGTASSSPGTPGSGTASSSPGSSTPSGATGSPGSSTPSGAT<br>GSPGPGSSPSASTGTGPGASPGTSSTGSPGASPGTSSTGSPGASPGTSSTGSPGASPGTSSTGSP<br>GTPGSGTASSSPGTPGSGTASSSPGSSPSASTGTGPGSSTPSGATGSPGASPGTSSTGSPGSS<br>TPSGATGSPGSSTPSGATGSPGSSPSASTGTGPGASPGTSSTGSPGTPGSGTASSSPGSSPSA<br>STGTGPGSSPSASTGTGPGASPGTSSTGSPGASPGTSSTGSPGTPGSGTASSSPGASPGTSST<br>GSPGTPGSGTASSSPGTPGSGTASSSPGSSTPSGATGSPGTPGSGTASSSPGASPGTSSTGSP<br>GSSTPSGATGSPGSSTPSGATGSPGSSPSASTGTGPGSSTPSGATGSPGSSTPSGATGSPGAS<br>PGTSSTGSPGSSPSASTGTGPGTPGSGTASSSPGASPGTSSTGSPGSSPSASTGTGPGTPGSG<br>TASSSPGSSPSASTGTGPGTPGSGTASSSPGASPGTSSTGSPGASPGTSSTGSPGTPGSGTAS<br>SSPGTPGSGTASSSPGSSTPSGATGSPGSSTPSGATGSPGTPGSGTASSSPGSSTPSGATGSP<br>GSSTPSGATGSPGASPGTSSTGSPGSSPSASTGTGPGSSTPSGATGSPGSSPSASTGTGPGSS<br>PSASTGTGPGASPGTSSTGSPGSSTPSGATGSPGASPGTSSTGSPGTPGSGTASSSPGTPGSG<br>TASSSPGSSPSASTGTGPGASPGTSSTGSPGSSTPSGATGSPGSSPSASTGTGPGSSPSASTG<br>TGPGASPGTSSTGSPGTPGSGTASSSPGSSTPSGATGSPGTPGSGTASSSPGSSPSASTGTGP<br>GSSPSASTGTGPGASP |
| AE72B | 105 | SPAGSPTSTEEGSPAGSPTSTEEGTSESATPESGPGTSTEPSEGSAPGTSESATPESGPGSEP<br>ATSGSETPG |
| AE72C | 106 | TSESATPESGPGTSESATPESGPGSEPATSGSETPGSEPATSGSETPGSPAGSPTSTEEGTSTE<br>PSEGSAPG |
| AE108A | 107 | TEEGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTS |
| AE108B | 108 | GSPAGSPTSTEEGTSTEPSEGSAPGTSESATPESGPGTSESATPESGPGTSESATPESGPGSE<br>PATSGSETPGSEPATSGSETPGSPAGSPTSTEEGTSTEPSEGSAP |
| AE144A | 109 | STEPSEGSAPGSPAGSPTSTEEGTSTEPSEGSAPGTSESATPESGPGSEPATSGSETPGTSES<br>ATPESGPGSEPATSGSETPGTSESATPESGPGTSTEPSEGSAPGTSESATPESGPGSPAGSPT<br>STEEGSPAGSPTSTEEGS |
| AE144B | 110 | SEPATSGSETPGTSESATPESGPGSEPATSGSETPGTSESATPESGPGTSTEPSEGSAPGSPA<br>GSPTSTEEGTSESATPESGPGSEPATSGSETPGTSESATPESGPGSPAGSPTSTEEGSPAGSP<br>TSTEEGTSTEPSEGSAPG |
| AE180A | 111 | TSTEEGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATS |

TABLE 4-continued

XTEN Polypeptides

| XTEN Name | SEQ ID NO: | Amino Acid Sequence |
|---|---|---|
| AE216A | 112 | PESGPGTSTEPSEGSAPGSPAGSPTSTEEGTSESATPESGPGSEPATSGSETPGTSESATPES<br>GPGSPAGSPTSTEEGSPAGSPTSTEEGTSTEPSEGSAPGTSESATPESGPGTSESATPESGPG<br>TSESATPESGPGSEPATSGSETPGSEPATSGSETPGSPAGSPTSTEEGTSTEPSEGSAPGTSTE<br>PSEGSAPGSEPATSGSETPGTSESAT |
| AE252A | 113 | ESGPGSEPATSGSETPGTSESATPESGPGTSTEPSEGSAPGSPAGSPTSTEEGTSESATPESG<br>PGSEPATSGSETPGTSESATPESGPGSPAGSPTSTEEGSPAGSPTSTEEGTSTEPSEGSAPGT<br>SESATPESGPGTSESATPESGPGTSESATPESGPGSEPATSGSETPGSEPATSGSETPGSPAG<br>SPTSTEEGTSTEPSEGSAPGTSTEPSEGSAPGSEPATSGSETPGTSESATPESGPGTSTEPSE |
| AE288A | 114 | TPESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGSESATPESGPGSEPATSGSETP<br>GTSESATPESGPGSPAGSPTSTEEGSPAGSPTSTEEGTSTEPSEGSAPGTSESATPESGPGTS<br>ESATPESGPGTSESATPESGPGSEPATSGSETPGSEPATSGSETPGSPAGSPTSTEEGTSTEPS<br>EGSAPGTSTEPSEGSAPGSEPATSGSETPGTSESA |
| AE324A | 115 | PESGPGSPAGSPTSTEEGSPAGSPTSTEEGSPAGSPTSTEEGTSESATPESGPGTSTEPSEGS<br>APGTSESATPESGPGSEPATSGSETPGTSESATPESGPGSEPATSGSETPGTSESATPESGPG<br>TSTEPSEGSAPGSPAGSPTSTEEGTSESATPESGPGSEPATSGSETPGTSESATPESGPGSPA<br>GSPTSTEEGSPAGSPTSTEEGTSTEPSEGSAPGTSESATPESGPGTSESATPESGPGTSESATP<br>ESGPGSEPATSGSETPGSEPATSGSETPGSPAGSPTSTEEGTSTEPSEGSAPGTSTEPSEGSA<br>PGSEPATS |
| AE360A | 116 | PESGPGTSTEPSEGSAPGTSESATPESGPGSPAGSPTSTEEGSPAGSPTSTEEGSPAGSPTSTE<br>EGTSESATPESGPGTSTEPSEGSAPGTSESATPESGPGSEPATSGSETPGTSESATPESGPGS<br>EPATSGSETPGTSESATPESGPGTSTEPSEGSAPGSPAGSPTSTEEGTSESATPESGPGSEPA<br>TSGSETPGTSESATPESGPGSPAGSPTSTEEGSPAGSPTSTEEGTSTEPSEGSAPGTSESATPE<br>SGPGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESAT |
| AE396A | 117 | PESGPGSEPATSGSETPGTSESATPESGPGTSTEPSEGSAPGTSESATPESGPGSPAGSPTSTE<br>EGSPAGSPTSTEEGSPAGSPTSTEEGTSESATPESGPGTSTEPSEGSAPGTSESATPESGPGS<br>EPATSGSETPGTSESATPESGPGSEPATSGSETPGTSESATPESGPGTSTEPSEGSAPGSPAG<br>SPTSTEEGTSESATPESGPGSEPATSGSETPGTSESATPESGPGSPAGSPTSTEEGSPAGSPTS<br>TEEGTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPS |
| AE432A | 118 | EGSAPGSPAGSPTSTEEGTSTEPSEGSAPGTSESATPESGPGSEPATSGSETPGTSESATPES<br>GPGSEPATSGSETPGTSESATPESGPGTSTEPSEGSAPGTSESATPESGPGSPAGSPTSTEEG<br>SPAGSPTSTEEGSPAGSPTSTEEGTSESATPESGPGTSTEPSEGSAPGTSESATPESGPGSEP<br>ATSGSETPGTSESATPESGPGSEPATSGSETPGTSESATPESGPGTSTEPSEGSAPGSPAGSP<br>TSTEEGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATS |
| AE468A | 119 | EGSAPGTSTEPSEGSAPGTSTEPSEGSAPGSPAGSPTSTEEGTSTEPSEGSAPGTSESATPES<br>GPGSEPATSGSETPGTSESATPESGPGSEPATSGSETPGTSESATPESGPGTSTEPSEGSAPG<br>TSESATPESGPGSPAGSPTSTEEGSPAGSPTSTEEGSPAGSPTSTEEGTSESATPESGPGTSTE<br>PSEGSAPGTSESATPESGPGSEPATSGSETPGTSESATPESGPGSEPATSGSETPGTSESATP<br>ESGPGTSTEPSEGSAPGSPAGSPTSTEEGTSESATPESGPGSEPATSGSETPGTSESATPESG<br>PGSPAGSPTSTEEGSPAGSPTSTEEGTSTEPSEGSAPGTSESATPESGPGTSESATPESGPGT<br>SESATPESGPGSEPATSGSETPGSEPATSGSETPGSPAGSPTSTEEGTSTEPSEGSAPGTSTEP<br>SEGSAPGSEPATSGSETPGTSESAT |
| AE504A | 120 | EGSAPGTSTEPSEGSAPGTSTEPSEGSAPGTSTEPSEGSAPGTSTEPSEGSAPGSPAGSPTST<br>EEGTSTEPSEGSAPGTSESATPESGPGSEPATSGSETPGTSESATPESGPGSEPATSGSETPG<br>TSESATPESGPGTSTEPSEGSAPGTSESATPESGPGSPAGSPTSTEEGSPAGSPTSTEEGSPA<br>GSPTSTEEGTSESATPESGPGTSTEPSEGSAPGTSESATPESGPGSEPATSGSETPGTSESATP<br>ESGPGSEPATSGSETPGTSESATPESGPGTSTEPSEGSAPGSPAGSPTSTEEGTSESATPESG<br>PGSEPATSGSETPGTSESATPESGPGSPAGSPTSTEEGSPAGSPTSTEEGTSTEPSEGSAPGT<br>SESATPESGPGTSESATPESGPGTSESATPESGPGSEPATSGSETPGSEPATSGSETPGSPAG<br>SPTSTEEGTSTEPSEGSAPGTSTEPSEGSAPGSEPATSGSETPGTSESATPESGPGTSTEPS |
| AE540A | 121 | TPESGPGSPAGSPTSTEEGTSESATPESGPGSEPATSGSETPGTSESATPESGPGTSTEPSEGS<br>APGTSTEPSEGSAPGTSTEPSEGSAPGTSTEPSEGSAPGTSTEPSEGSAPGTSTEPSEGSAPG<br>SPAGSPTSTEEGTSTEPSEGSAPGTSESATPESGPGSEPATSGSETPGTSESATPESGPGSEP<br>ATSGSETPGTSESATPESGPGTSTEPSEGSAPGTSESATPESGPGSPAGSPTSTEEGSPAGSP<br>TSTEEGSPAGSPTSTEEGTSESATPESGPGTSTEPSEGSAPGTSESATPESGPGSEPATSGSE<br>TPGTSESATPESGPGSEPATSGSETPGTSESATPESGPGTSTEPSEGSAPGSPAGSPTSTEEG<br>TSESATPESGPGSEPATSGSETPGTSESATPESGPGSPAGSPTSTEEGSPAGSPTSTEEGTSTE<br>PSEGSAPGTSESATPESGPGTSESATPESGPGTSESATPESGPGSEPATSGSETPGSEPATSG<br>SETPGSPAGSPTSTEEGTSTEPSEGSAPGTSTEP |

TABLE 4-continued

XTEN Polypeptides

| XTEN Name | SEQ ID NO: | Amino Acid Sequence |
|---|---|---|
| AE576A | 122 | TPESGPGTSESATPESGPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPGTSTEPSEGPGSEPATSGSETPGTSES<br>ATPESGPGSEPATSGSETPGTSESATPESGPGTSTEPSEGSAPGTSESATPESGPGSPAGSPT<br>STEEGSPAGSPTSTEEGSPAGSPTSTEEGTSESATPESGPGTSTEPSEGSAPGTSESATPESGP<br>GSEPATSGSETPGTSESATPESGPGSEPATSGSETPGTSESATPESGPGTSTEPSEGSAPGSP<br>AGSPTSTEEGTSESATPESGPGSEPATSGSETPGTSESATPESGPGSPAGSPTSTEEGSPAGS<br>PTSTEEGTSTEPSEGSAPGTSESATPESGPGTSESATPESGPGTSESATPESGPGSEPATSGSE<br>TPGSEPATSGSETPGSPAGSPTSTEEGTSTEPSEGSAPGTSTEPSEGSAPGSEPATSGSETPG<br>TSESA |
| AE612A | 123 | GSETPGTSTEPSEGSAPGTSTEPSEGSAPGTSESATPESGPGTSESATPESGPGSPAGSPTST<br>EEGTSESATPESGPGSEPATSGSETPGTSESATPESGPGTSTEPSEGSAPGTSTEPSEGSAPG<br>TSTEPSEGSAPGTSTEPSEGSAPGTSTEPSEGSAPGTSTEPSEGSAPGSPAGSPTSTEEGTSTE<br>PSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTE<br>EGTSESATPESGPGTSTEPSEGSAPGTSESATPESGPGSEPATSGSETPGTSESATPESGPGS<br>EPATSGSETPGTSESATPESGPGTSTEPSEGSAPGSPAGSPTSTEEGTSESATPESGPGSEPA<br>TSGSETPGTSESATPESGPGSPAGSPTSTEEGSPAGSPTSTEEGTSTEPSEGSAPGTSESATPE<br>SGPGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESAT |
| AE648A | 124 | PESGPGTSTEPSEGSAPGTSESATPESGPGSEPATSGSETPGTSTEPSEGSAPGTSTEPSEGS<br>APGTSESATPESGPGTSESATPESGPGSPAGSPTSTEEGTSESATPESGPGSEPATSGSETPG<br>TSESATPESGPGTSTEPSEGSAPGTSTEPSEGSAPGTSTEPSEGSAPGTSTEPSEGSAPGTSTE<br>PSEGSAPGTSTEPSEGSAPGSPAGSPTSTEEGTSTEPSEGSAPGTSESATPESGPGSEPATSG<br>SETPGTSESATPESGPGSEPATSGSETPGTSESATPESGPGTSTEPSEGSAPGTSESATPESGP<br>GSPAGSPTSTEEGSPAGSPTSTEEGSPAGSPTSTEEGTSESATPESGPGTSTEPSEGSAPGTS<br>ESATPESGPGSEPATSGSETPGTSESATPESGPGSEPATSGSETPGTSESATPESGPGTSTEPS<br>EGSAPGSPAGSPTSTEEGTSESATPESGPGSEPATSGSETPGTSESATPESGPGSPAGSPTST<br>EEGSPAGSPTSTEEGTSTEPSEGSAPGTSESATPESGPGTSESATPESGPGTSESATPESGPG<br>SEPATSGSETPGSEPATSGSETPGSPAGSPTSTEEGTSTEPSEGSAPGTSTEPSEGSAPGSEP<br>ATSGSETPGTSESAT |
| AE684A | 125 | EGSAPGSPAGSPTSTEEGTSTEPSEGSAPGTSTEPSEGSAPGTSESATPESGPGTSTEPSEGS<br>APGTSESATPESGPGSEPATSGSETPGTSTEPSEGSAPGTSTEPSEGSAPGTSESATPESGPG<br>TSESATPESGPGSPAGSPTSTEEGTSESATPESGPGSEPATSGSETPGTSESATPESGPGTSTE<br>PSEGSAPGTSTEPSEGSAPGTSTEPSEGSAPGTSTEPSEGSAPGTSTEPSEGSAPGTSTEPSE<br>GSAPGSPAGSPTSTEEGTSTEPSEGSAPGTSESATPESGPGSEPATSGSETPGTSESATPESG<br>PGSEPATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAPGTSESATPESGPGSEPAT<br>SGSETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTEEG<br>TSTEPSEGSAPGTSESATPESGPGTSESATPESGPGTSESATPESGPGSEPATSGSETPGSEP<br>ATSGSETPGSPAGSPTSTEEGTSTEPSEGSAPGTSTEPSEGSAPGSEPATS |
| AE720A | 126 | TSGSETPGSEPATSGSETPGSPAGSPTSTEEGTSESATPESGPGTSTEPSEGSAPGTSTEPSEG<br>SAPGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPGTS<br>ESATPESGPGSPAGSPTSTEEGTSESATPESGPGSEPATSGSETPGTSESATPESGPGTSTEPS<br>EGSAPGTSTEPSEGSAPGTSTEPSEGSAPGTSTEPSEGSAPGTSTEPSEGSAPGTSTEPSEGS<br>APGSPAGSPTSTEEGTSTEPSEGSAPGTSESATPESGPGSEPATSGSETPGTSESATPESGPG<br>SEPATSGSETPGTSESATPESGPGTSTEPSEGSAPGTSESATPESGPGSPAGSPTSTEEGSPA<br>GSPTSTEEGSPAGSPTSTEEGTSESATPESGPGTSTEPSEGSAPGTSESATPESGPGSEPATS<br>GSETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTEEG<br>TSTEPSEGSAPGTSESATPESGPGTSESATPESGPGTSESATPESGPGSEPATSGSETPGSEP<br>ATSGSETPGSPAGSPTSTEEGTSTE |
| AE756A | 127 | TSGSETPGSEPATSGSETPGSPAGSPTSTEEGTSESATPESGPGTSTEPSEGSAPGTSTEPSEG<br>SAPGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPGTS<br>ESATPESGPGSPAGSPTSTEEGTSESATPESGPGSEPATSGSETPGTSESATPESGPGTSTEPS<br>EGSAPGTSTEPSEGSAPGTSTEPSEGSAPGTSTEPSEGSAPGTSTEPSEGSAPGTSTEPSEGS<br>APGSPAGSPTSTEEGTSTEPSEGSAPGTSESATPESGPGSEPATSGSETPGTSESATPESGPG<br>SEPATSGSETPGTSESATPESGPGTSTEPSEGSAPGTSESATPESGPGSPAGSPTSTEEGSPA<br>GSPTSTEEGSPAGSPTSTEEGTSESATPESGPGTSTEPSEGSAPGTSESATPESGPGSEPATS<br>GSETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTEEG<br>TSTEPSEGSAPGTSESATPESGPGTSESATPESGPGTSESATPESGPGSEPATSGSETPGSEP<br>ATSGSETPGSPAGSPTSTEEGTSTEPSEGSAPGTSTEPSEGSAPGSEPATSGSETPGTSES |
| AE792A | 128 | EGSAPGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSTEPSEGSAPGTSTEPSEGSAPG<br>TSESATPESGPGTSTEPSEGSAPGTSESATPESGPGSEPATSGSETPGTSTEPSEGSAPGTSTE |

TABLE 4-continued

XTEN Polypeptides

| XTEN Name | SEQ ID NO: | Amino Acid Sequence |
|---|---|---|
| | | PSEGSAPGTSESATPESGPGTSESATPESGPGSPAGSPTSTEEGTSESATPESGPGSEPATSG SETPGTSESATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSESATPESGPGTSESATPESGPGSE PATSGSETPGTSESATPESGPGSEPATSGSETPGTSESATPESGPGTSTEPSEGSAPGTSESA TPESGPGSPAGSPTSTEEGSPAGSPTSTEEGSPAGSPTSTEEGTSESATPESGPGTSTEPSEGS APGTSESATPESGPGSEPATSGSETPGTSESATPESGPGSEPATSGSETPGTSESATPESGPG TSTEPSEGSAPGSPAGSPTSTEEGTSESATPESGPGSEPATSGSETPGTSESATPESGPGSPA GSPTSTEEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPSEGSA PGSEPATSGSETPGTSESATPESGPGTSTEPS |
| AE828A | 129 | PESGPGTSTEPSEGSAPGSPAGSPTSTEEGTSTEPSEGSAPGTSTEPSEGSAPGTSESATPES GPGSEPATSGSETPGSEPATSGSETPGSPAGSPTSTEEGTSESATPESGPGTSTEPSEGSAPG TSTEPSEGSAPGSPAGSPTSTEEGTSTEPSEGSAPGTSTEPSEGSAPGTSESATPESGPGTSTE PSEGSAPGTSESATPESGPGSEPATSGSETPGTSTEPSEGSAPGTSTEPSEGSAPGTSESATP ESGPGTSESATPESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSES ATPESGPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESATPESGP GSEPATSGSETPGTSESATPESGPGSEPATSGSETPGTSESATPESGPGTSTEPSEGSAPGSP AGSPTSTEEGTSESATPESGPGSEPATSGSETPGTSESATPESGPGSPAGSPTSTEEGSPAGS PTSTEEGTSTEPSEGSAPGTSESATPESGPGTSESATPESGPGTSESATPESGPGSEPATSGSE TPGSEPATSGSETPGSPAGSPTSTEEGTSTEPSEGSAPGTSTEPSEGSAPGSEPATSGSETPG TSESAT |
| AG72A | 130 | GPGSSPSASTGTGPGTPGSGTASSSPGSSTPSGATGSPGSSPSASTGTGPGASPGTSSTGSPG TPGSGTASS |
| AG72B | 131 | GSSTPSGATGSPGSSTPSGATGSPGSSPSASTGTGPGSSPSASTGTGPGASPGTSSTGSPGTP GSGTASSSP |
| AG72C | 132 | SPSASTGTGPGASPGTSSTGSPGSSPSASTGTGPGTPGSGTASSSPGSSTPSGATGSPGSSTP SGATGSPGA |
| AG108A | 133 | SASTGTGPGSSPSASTGTGPGTPGSGTASSSPGSSTPSGATGSPGSSPSASTGTGPGASPGTS STGSPGTPGSGTASSSPGSSTPSGATGSPGTPGSGTASSSPGASP |
| AG108B | 134 | PGTPGSGTASSSPGSSTPSGATGSPGTPGSGTASSSPGSSTPSGATGSPGSSTPSGATGSPGS SPSASTGTGPGSSPSASTGTGPGASPGTSSTGSPGTPGSGTASSS |
| AG144A | 135 | PGSSPSASTGTGPGSSPSASTGTGPGTPGSGTASSSPGSSTPSGATGSPGSSPSASTGTGPGA SPGTSSTGSPGTPGSGTASSSPGSSTPSGATGSPGTPGSGTASSSPGASPGTSSTGSPGASPG TSSTGSPGTPGSGTASSS |
| AG144B | 136 | PSGATGSPGTPGSGTASSSPGSSTPSGATGSPGSSTPSGATGSPGSSPSASTGTGPGSSPSAS TGTGPGASPGTSSTGSPGTPGSGTASSSPGSSTPSGATGSPGTPGSGTASSSPGASPGTSSTG SPGASPGTSSTGSPGASP |
| AG180A | 137 | TSSTGSPGSSPSASTGTGPGSSPSASTGTGPGTPGSGTASSSPGSSTPSGATGSPGSSPSAST GTGPGASPGTSSTGSPGTPGSGTASSSPGSSTPSGATGSPGTPGSGTASSSPGASPGTSSTGS PGASPGTSSTGSPGTPGSGTASSSPGSSTPSGATGSPGASPGTSSTGSPGTPGS |
| AG216A | 138 | TGTGPGSSPSASTGTGPGTPGSGTASSSPGSSTPSGATGSPGSSPSASTGTGPGASPGTSSTG SPGTPGSGTASSSPGSSTPSGATGSPGTPGSGTASSSPGASPGTSSTGSPGASPGTSSTGSPG TPGSGTASSSPGSSTPSGATGSPGASPGTSSTGSPGTPGSGTASSSPGSSTPSGATGSPGSSP SASTGTGPGSSPSASTGTGPGSSTPSG |
| AG252A | 139 | TSSTGSPGSSPSASTGTGPGSSPSASTGTGPGTPGSGTASSSPGSSTPSGATGSPGSSPSAST GTGPGASPGTSSTGSPGTPGSGTASSSPGSSTPSGATGSPGTPGSGTASSSPGASPGTSSTGS PGASPGTSSTGSPGTPGSGTASSSPGSSTPSGATGSPGASPGTSSTGSPGTPGSGTASSSPGS STPSGATGSPGSSPSASTGTGPGSSPSASTGTGPGSSTPSGATGSPGSSTPSGATGSPGASPG |
| AG288A | 140 | TSSTGSPGSSPSASTGTGPGSSPSASTGTGPGTPGSGTASSSPGSSTPSGATGSPGSSPSAST GTGPGASPGTSSTGSPGTPGSGTASSSPGSSTPSGATGSPGTPGSGTASSSPGASPGTSSTGS PGASPGTSSTGSPGTPGSGTASSSPGSSTPSGATGSPGASPGTSSTGSPGTPGSGTASSSPGS STPSGATGSPGSSPSASTGTGPGSSPSASTGTGPGSSTPSGATGSPGSSTPSGATGSPGASPG TSSTGSPGASPGTSSTGSPGASPGTSSTGSPGTPGS |
| AG324A | 141 | TSSTGSPGTPGSGTASSSPGASPGTSSTGSPGASPGTSSTGSPGASPGTSSTGSPGASPGTSS TGSPGTPGSGTASSSPGSSTPSGATGSPGTPGSGTASSSPGSSTPSGATGSPGTPGSGTASSS PGSSTPSGATGSPGSSTPSGATGSPGSSPSASTGTGPGSSPSASTGTGPGASPGTSSTGSPGT PGSGTASSSPGSSTPSGATGSPGSSPSASTGTGPGSSPSASTGTGPGASPGTSSTGSPGASPG TSSTGSPGSSTPSGATGSPGSSPSASTGTGPGASPGTSSTGSPGSSPSASTGTGPGTPGSGTA SSSPGSSTP |

TABLE 4-continued

XTEN Polypeptides

| XTEN Name | SEQ ID NO: | Amino Acid Sequence |
|---|---|---|
| AG360A | 142 | TSSTGSPGASPGTSSTGSPGTPGSGTASSSPGASPGTSSTGSPGASPGTSS TGSPGASPGTSSTGSPGTPGSGTASSSPGSSTPSGATGSPGTPGSGTASGS PGTPGSGTASSSPGSSTPSGATGSPGSSTPSGATGSPGSSPSASTGTGPGA SPGTSSTGSPGTPGSGTASSSPGSSTPSGATGSPGSSPSASTGTGPGASPG TSSTGSPGASPGTSSTGSPGSSTPSGATGSPGSSPSASTGTGPGASPGTSSTGSPGSSPSAST GTGPGTPGSGTASSSPGSSTPSGATGSPGSSTPSGATGSPGASPG |
| AG396A | 143 | GATGSPGSSTPSGATGSPGSSPSASTGTGPGASPGTSSTGSPGASPGTSSTGSPGTPGSGTA SSSPGASPGTSSTGSPGASPGTSSTGSPGASPGTSSTGSPGTPGSGTASSS PGSSTPSGATGSPGTPGSGTASSSPGSSTPSGATGSPGTPGSGTASSSPGSSTPSGATGSPGS STPSGATGSPGSSPSASTGTGPGSSPSASTGTGPGASPGTSSTGPGTPGSGTASSSPGSSTP SGATGSPGSSPSASTGTGPGSSPSASTGTGPGASPGTSSTGSPGASPGTSSTGSPGSSTPSGA TGSPGSSPSASTGTGPGASPGTSSTGSPGSSPSASTGTGPGTPGSGTASSSPGSSTPSGATGS PGSSTPSGATGSPGASPGT |
| AG432A | 144 | GATGSPGSSTPSGATGSPGASPGTSSTGSPGTPGSGTASSSPGSSTPSGATGSPGSSTPSGAT GSPGSSTPSGATGSPGSSPSASTGTGPGASPGTSSTGSPGASPGTSSTGSPGTPGSGTASSSP GASPGTSSTGSPGASPGTSSTGSPGASPGTSSTGSPGTPGSGTASSSPGSS TPSGATGSPGTPGSGTASSSPGSSTPSGATGSPGTPGSGTASSSPGSSTPS GATGSPGSSPSASTGTGPGSSPSASTGTGPGASPGTSSTGSPGTPGSGTASSSPGSSTPSGAT GSPGSSPSASTGTGPGSSPSASTGTGPGASPGTSSTGSPGASPGTSSTGSPGSSTPSGATGSP GSSPSASTGTGPGASPGTSSTGSPGSSPSASTGTGPGTPGSGTASSSPGSSTPS |
| AG468A | 145 | TSSTGSPGSSPSASTGTGPGTPGSGTASSSPGASPGTSSTGSPGASPGTSSTGSPGASPGTSS TGSPGSSTPSGATGSPGSSTPSGATGSPGASPGTSSTGSPGTPGSGTASSSPGSSTPSGATGS PGSSTPSGATGSPGSSTPSGATGSPGSSPSASTGTGPGASPGTSSTGSPGASPGTSSTGSPGT PGSGTASSSPGASPGTSSTGSPGASPGTSSTGSPGASPGTSSTGSPGASPGTSSTGSPGSSPGS GTASSSPGSSTPSGATGSPGTPGSGTASSSPGSSTPSGATGSPGTPGSGTASSSPGSSTPSGA TGSPGSSTPSGATGSPGSSPSASTGTGPGSSPSASTGTGPGASPGTSSTGSPGTPGSGTASSS PGSSTPSGATGSPGSSPSASTGTGPGSSPSASTGTGPGASPGTSSTGSPGASPGTSSTGSPGS STPSGATGSPGSSPSASTGTGPGASPG |
| AG504A | 146 | TSSTGSPGSSPSASTGTGPGTPGSGTASSSPGASPGTSSTGSPGASPGTSSTGSPGASPGTSS TGSPGSSTPSGATGSPGSSTPSGATGSPGASPGTSSTGSPGTPGSGTASSSPGSSTPSGATGS PGSSTPSGATGSPGSSTPSGATGSPGSSPSASTGTGPGASPGTSSTGSPGASPGTSSTGSPGT PGSGTASSSPGASPGTSSTGSPGASPGTSSTGSPGASPGTSSTGSPGASPGTSSTGSPGSSPGS GTASSSPGSSTPSGATGSPGTPGSGTASSSPGSSTPSGATGSPGTPGSGTASSSPGSSTPSGA TGSPGSSTPSGATGSPGSSPSASTGTGPGSSPSASTGTGPGASPGTSSTGSPGTPGSGTASSS PGSSTPSGATGSPGSSPSASTGTGPGSSPSASTGTGPGASPGTSSTGSPGASPGTSSTGSPGS STPSGATGSPGSSPSASTGTGPGASPGTSSTGSPGSSPSASTGTGPGTPGSGTASSSPGSSTP |
| AG540A | 147 | TSSTGSPGASPGTSSTGSPGSSPSASTGTGPGTPGSGTASSSPGASPGTSSTGSPGASPGTSS TGSPGASPGTSSTGSPGSSTPSGATGSPGSSTPSGATGSPGASPGTSSTGSPGTPGSGTASSS PGSSTPSGATGSPGSSTPSGATGSPGSSTPSGATGSPGSSPSASTGTGPGASPGTSSTGSPGA SPGTSSTGSPGTPGSGTASSSPGASPGTSSTGSPGASPGTSSTGSPGASPGTSSTGSPGASPG TSSTGSPGTPGSGTASSSPGSSTPSGATGSPGTPGSGTASSSPGSSTPSGATGSPGTPGSGTA SSSPGSSTPSGATGSPGSSTPSGATGSPGSSPSASTGTGPGSSPSASTGTGPGASPGTSSTGS PGTPGSGTASSSPGSSTPSGATGSPGSSPSASTGTGPGSSPSASTGTGPGASPGTSSTGSPGA SPGTSSTGSPGSSTPSGATGSPGSSPSASTGTGPGASPGTSSTGSPGSSPSASTGTGPGTPGS GTASSSPGSSTPSGATGSPGSSTPSGATGSPGASPG |
| AG576A | 148 | TSSTGSPGTPGSGTASSSPGASPGTSSTGSPGASPGTSSTGSPGASPGTSSTGSPGSSPSAST GTGPGTPGSGTASSSPGASPGTSSTGSPGASPGTSSTGSPGASPGTSSTGSPGSSTPSGATGS PGSSTPSGATGSPGASPGTSSTGSPGTPGSGTASSSPGSSTPSGATGSPGSSTPSGATGSPGS STPSGATGSPGSSPSASTGTGPGASPGTSSTGSPGASPGTSSTGSPGTPGSGTASSSPGASPG TSSTGSPGASPGTSSTGSPGASPGTSSTGSPGASPGTSSTGSPGTPGSGTASSSPGSSTPSGA TGSPGTPGSGTASSSPGSSTPSGATGSPGTPGSGTASSSPGSSTPSGATGSPGSSTPSGATGS PGSSPSASTGTGPGSSPSASTGTGPGASPGTSSTGSPGTPGSGTASSSPGSSTPSGATGSPGS SPSASTGTGPGSSPSASTGTGPGASPGTSSTGSPGASPGTSSTGSPGSSTPSGATGSPGSSPS ASTGTGPGASPGTSSTGSPGSSPSASTGTGPGTPGSGTASSSPGSSTPSGATGSPGSSTPSGA TGSPGASPG |
| AG612A | 149 | STGSPGTPGSGTASSSPGSSTPSGATGSPGASPGTSSTGSPGTPGSGTASSSPGSSTPSGATG SPGSSPSASTGTGPGSSPSASTGTGPGSSTPSGATGSPGSSTPSGATGSPGASPGTSSTGSPG ASPGTSSTGSPGASPGTSSTGSPGTPGSGTASSSPGASPGTSSTGSPGASPGTSSTGSPGASP GTSSTGSPGSSPSASTGTGPGTPGSGTASSSPGASPGTSSTGSPGASPGTS STGSPGSSTPSGATGSPGSSTPSGATGSPGASPGTSSTGSPGSSSTPSGATG SPGSSTPSGATGSPGSSTPSGATGSPGSSPSASTGTGPGASPGTSSTGSPGASPGTSSTGSPG TPGSGTASSSPGASPGTSSTGSPGASPGTSSTGSPGASPGTSSTGSPGASPGTSSTGSPGTPG SGTASSSPGSSTPSGATGSPGTPGSGTASSSPGSSTPSGATGSPGTPGSGTASSSPGSSTPSG ATGSPGSSTPSGATGSPGSSPSASTGTGPGSSPSASTGTGPGASPGTSSTGSPGTPGSGTASS SPGSSTPSGATGSPGSSPSASTGTGPGSSPSASTGTGPGASPGTS |

TABLE 4-continued

XTEN Polypeptides

| XTEN Name | SEQ ID NO: | Amino Acid Sequence |
|---|---|---|
| AG648A | 150 | GTASSSPGSSTPSGATGSPGSSPSASTGTGPGSSPSASTGTGPGSSTPSGATGSPGSSTPSGA<br>TGSPGASPGTSSTGSPGASPGTSSTGSPGASPGTSSTGSPGTPGSGTASSSPGASPGTSSTGS<br>PGASPGTSSTGSPGASPGTSSTGSPGSSPSASTGTGPGTPGSGTASSSPGASPGTSSTGSPGA<br>SPGTSSTGSPGASPGTSSTGSPGSSTPSGATGSPGSSTPSGATGSPGASPGTSSTGSPGTPGS<br>GTASSSPGSSTPSGATGSPGSSTPSGATGSPGSSTPSGATGSPGSSPSASTGTGPGASPGTSS<br>TGSPGASPGTSSTGSPGTPGSGTASSSPGASPGTSSTGSPGASPGTSSTGSPGASPGTSSTGS<br>PGASPGTSSTGSPGTPGSGTASSSPGSSTPSGATGSPGTPGSGTASSSPGSSTPSGATGSPGT<br>PGSGTASSSPGSSTPSGATGSPGSSTPSGATGSPGSSPSASTGTGPGSSPSASTGTGPGASPG<br>TSSTGSPGTPGSGTASSSPGSSTPSGATGSPGSSPSASTGTGPGSSPSASTGTGPGASPGTSS<br>TGSPGASPGTSSTGSPGSSTPSGATGSPGSSPSASTGTGPGASPGTSSTGSPGSSPSASTGTG<br>PGTPGSGTASSSPGSSTP |
| AG684A | 151 | TSSTGSPGTPGSGTASSSPGSSTPSGATGSPGSSPSASTGTGPGSSPSASTGTGPGSSTPSGA<br>TGSPGSSTPSGATGSPGASPGTSSTGSPGASPGTSSTGSPGASPGTSSTGSPGTPGSGTASSS<br>PGASPGTSSTGSPGASPGTSSTGSPGASPGTSSTGSPGSSPSASTGTGPGTPGSGTASSSPGA<br>SPGTSSTGSPGASPGTSSTGSPGASPGTSSTGSPGSSTPSGATGSPGSSTPSGATGSPGASPG<br>TSSTGSPGTPGSGTASSSPGSSTPSGATGSPGSSTPSGATGSPGSSTPSGATGSPGSSPSAST<br>GTGPGASPGTSSTGSPGASPGTSSTGSPGTPGSGTASSSPGASPGTSSTGSPGASPGTSSTGS<br>PGASPGTSSTGSPGASPGTSSTGSPGTPGSGTASSSPGSSTPSGATGSPGTPGSGTASSSPGS<br>STPSGATGSPGTPGSGTASSSPGSSTPSGATGSPGSSPSASTGTGPGSSPS<br>ASTGTGPGASPGTSSTGSPGTPGSGTASSSPGSSTPSGATGSPGSSPSASTGTGPGSSPSAST<br>GTGPGASPGTSSTGSPGASPGTSSTGSPGSSTPSGATGSPGSSPSASTGTGPGASPGTSSTGS<br>PGSSPSASTGTGPGTPGSGTASSSPGSSTPSGATGSPGSSTPSGATGSPGASPG |
| AG720A | 152 | TSSTGSPGTPGSGTASSSPGSSTPSGATGSPGASPGTSSTGSPGTPGSGTASSSPGSSTPSGA<br>TGSPGSSPSASTGTGPGSSPSASTGTGPGSSTPSGATGSPGSSTPSGATGSPGASPGTSSTGS<br>PGASPGTSSTGSPGASPGTSSTGSPGTPGSGTASSSPGASPGTSSTGSPGASPGTSSTGSPGA<br>SPGTSSTGSPGSSPSASTGTGPGTPGSGTASSSPGASPGTSSTGSPGASPGTSSTGSPGASPG<br>TSSTGSPGSSTPSGATGSPGSSTPSGATGSPGASPGTSSTGSPGTPGSGTASSSPGSSTPSGA<br>TGSPGSSTPSGATGSPGSSTPSGATGSPGSSPSASTGTGPGASPGTSSTGSPGASPGTSSTGS<br>PGTPGSGTASSSPGASPGTSSTGSPGASPGTSSTGSPGASPGTSSTGSPGASPGTSSTGSPGT<br>PGSGTASSSPGSSTPSGATGSPGTPGSGTASSSPGSSTPSGATGSPGTPGSGTASSSPGSSTP<br>SGATGSPGSSTPSGATGSPGSSPSASTGTGPGSSPSASTGTGPGASPGTSSTGSPGTPGSGT<br>ASSSPGSSTPSGATGSPGSSPSASTGTGPGSSPSASTGTGPGASPGTSSTGSPGASPGTSSTG<br>SPGSSTPSGATGSPGSSPSASTGTGPGASPGTSSTGSPGSSPSASTGTGPGTPGSGTASSSPG<br>SSTPSGATGSPGSSTPSGATGSPGASPG |
| AG756A | 153 | TSSTGSPGSSPSASTGTGPGSSPSASTGTGPGTPGSGTASSSPGSSTPSGATGSPGSSPSAST<br>GTGPGASPGTSSTGSPGTPGSGTASSSPGSSTPSGATGSPGTPGSGTASSSPGASPGTSSTGS<br>PGASPGTSSTGSPGTPGSGTASSSPGSSTPSGATGSPGASPGTSSTGSPGTPGSGTASSSPGS<br>STPSGATGSPGSSPSASTGTGPGSSPSASTGTGPGSSTPSGATGSPGSSTPSGATGSPGASPG<br>TSSTGSPGASPGTSSTGSPGASPGTSSTGSPGTPGSGTASSSPGASPGTSSTGSPGASPGTSS<br>TGSPGASPGTSSTGSPGSSPSASTGTGPGTPGSGTASSSPGASPGTSSTGSPGASPGTSSTGS<br>PGASPGTSSTGSPGSSTPSGATGSPGSSTPSGATGSPGASPGTSSTGSPGTPGSGTASSSPGS<br>STPSGATGSPGSSTPSGATGSPGSSTPSGATGSPGSSPSASTGTGPGASPGTSSTGSPGASPG<br>TSSTGSPGTPGSGTASSSPGASPGTSSTGSPGASPGTSSTGSPGASPGTSSTGSPGASPGTSS<br>TGSPGTPGSGTASSSPGSSTPSGATGSPGTPGSGTASSSPGSSTPSGATGSPGTPGSGTASSS<br>PGSSTPSGATGSPGSSTPSGATGSPGSSPSASTGTGPGSSPSASTGTGPGASPGTSSTGSPGT<br>PGSGTASSSPGSSTPSGATGSPGSSPSASTGTGPGSSPSASTGTGPGASPGTSSTGSPGASPG |
| AG792A | 154 | TSSTGSPGSSPSASTGTGPGSSPSASTGTGPGTPGSGTASSSPGSSTPSGATGSPGSSPSAST<br>GTGPGASPGTSSTGSPGTPGSGTASSSPGSSTPSGATGSPGTPGSGTASSSPGASPGTSSTGS<br>PGASPGTSSTGSPGTPGSGTASSSPGSSTPSGATGSPGASPGTSSTGSPGTPGSGTASSSPGS<br>STPSGATGSPGSSPSASTGTGPGSSPSASTGTGPGSSTPSGATGSPGSSTPSGATGSPGASPG<br>TSSTGSPGASPGTSSTGSPGASPGTSSTGSPGTPGSGTASSSPGASPGTSSTGSPGASPGTSS<br>TGSPGASPGTSSTGSPGSSPSASTGTGPGTPGSGTASSSPGASPGTSSTGSPGASPGTSSTGS<br>PGASPGTSSTGSPGSSTPSGATGSPGSSTPSGATGSPGASPGTSSTGSPGTPGSGTASSSPGS<br>STPSGATGSPGSSTPSGATGSPGSSTPSGATGSPGSSPSASTGTGPGASPGTSSTGSPGASPG<br>TSSTGSPGTPGSGTASSSPGASPGTSSTGSPGASPGTSSTGSPGASPGTSSTGSPGASPGTSS<br>TGSPGTPGSGTASSSPGSSTPSGATGSPGTPGSGTASSSPGSSTPSGATGSPGTPGSGTASSS<br>PGSSTPSGATGSPGSSTPSGATGSPGSSPSASTGTGPGSSPSASTGTGPGASPGTSSTGSPGT<br>PGSGTASSSPGSSTPSGATGSPGSSPSASTGTGPGSSPSASTGTGPGASPGTSSTGSPGASPG<br>TSSTGSPGSSTPSGATGSPGSSPSASTGTGPGASPG |
| AG828A | 155 | TSSTGSPGSSPSASTGTGPGSSPSASTGTGPGTPGSGTASSSPGSSTPSGATGSPGSSPSAST<br>GTGPGASPGTSSTGSPGTPGSGTASSSPGSSTPSGATGSPGTPGSGTASSSPGASPGTSSTGS<br>PGASPGTSSTGSPGTPGSGTASSSPGSSTPSGATGSPGASPGTSSTGSPGTPGSGTASSSPGS<br>STPSGATGSPGSSPSASTGTGPGSSPSASTGTGPGSSTPSGATGSPGSSTPSGATGSPGASPG<br>TSSTGSPGASPGTSSTGSPGASPGTSSTGSPGTPGSGTASSSPGASPGTSSTGSPGASPGTSS<br>TGSPGASPGTSSTGSPGSSPSASTGTGPGTPGSGTASSSPGASPGTSSTGSPGASPGTSSTGS<br>PGASPGTSSTGSPGSSTPSGATGSPGSSTPSGATGSPGASPGTSSTGSPGTPGSGTASSSPGS<br>STPSGATGSPGSSTPSGATGSPGSSTPSGATGSPGSSPSASTGTGPGASPGTSSTGSPGASPG<br>TSSTGSPGTPGSGTASSSPGASPGTSSTGSPGASPGTSSTGSPGASPGTSSTGSPGASPGTSS<br>TGSPGTPGSGTASSSPGSSTPSGATGSPGTPGSGTASSSPGSSTPSGATGSPGTPGSGTASSS<br>PGSSTPSGATGSPGSSTPSGATGSPGSSPSASTGTGPGSSPSASTGTGPGASPGTSSTGSPGT |

TABLE 4-continued

XTEN Polypeptides

| XTEN Name | SEQ ID NO: | Amino Acid Sequence |
|---|---|---|
| | | PGSGTASSSPGSSTPSGATGSPGSSPSASTGTGPGSSPSASTGTGPGASPGTSSTGSPGASPG TSSTGSPGSSTPSGATGSPGSSPSASTGTGPGASPGTSSTGSPGSSPSASTGTGPGTPGSGTA SSSPGSSTP |

In other embodiments, the aaT-XTEN composition comprises one or more non-repetitive XTEN sequences of about 36 to about 3000 amino acid residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 8-11, either as a family sequence, or where motifs are selected from two or more families of motifs.

In those embodiments wherein the XTEN component of the aaT-XTEN fusion protein has less than 100% of its amino acids consisting of four to six amino acid selected from glycine (G), alanine (A), serine (S), threonine (T), glutamate (E) and proline (P), or less than 100% of the sequence consisting of the sequence motifs from Table 3 or the sequences of Tables 4, and 8-12 or less than 100% sequence identity compared with an XTEN from Table 4, the other amino acid residues are selected from any other of the 14 natural L-amino acids, but are preferentially selected from hydrophilic amino acids such that the XTEN sequence contains at least about 90%, or at least about 91%, or at least about 92%, or at least about 93%, or at least about 94%, or at least about 95%, or at least about 96%, or at least about 97%, or at least about 98%, or at least about 99% hydrophilic amino acids. The XTEN amino acids that are not glycine (G), alanine (A), serine (S), threonine (T), glutamate (E) and proline (P) are interspersed throughout the XTEN sequence, are located within or between the sequence motifs, or are concentrated in one or more short stretches of the XTEN sequence. In such cases where the XTEN component of the aaT-XTEN comprises amino acids other than glycine (G), alanine (A), serine (S), threonine (T), glutamate (E) and proline (P), it is preferred that the amino acids not be hydrophobic residues and should not substantially confer secondary structure of the XTEN component. Hydrophobic residues that are less favored in construction of XTEN include tryptophan, phenylalanine, tyrosine, leucine, isoleucine, valine, and methionine. Additionally, one can design the XTEN sequences to contain less than 5% or less than 4% or less than 3% or less than 2% or less than 1% or none of the following amino acids: cysteine (to avoid disulfide formation and oxidation), methionine (to avoid oxidation), asparagine and glutamine (to avoid desamidation). Thus, in some embodiments, the XTEN component of the aaT-XTEN fusion protein comprising other amino acids in addition to glycine (G), alanine (A), serine (S), threonine (T), glutamate (E) and proline (P) would have a sequence with less than 5% of the residues contributing to alpha-helices and beta-sheets as measured by the Chou-Fasman algorithm and have at least 90%, or at least about 95% or more random coil formation as measured by the GOR algorithm.

3. Length of Sequence

In another aspect, the invention provides aaT-XTEN compositions comprising an aaT and one or more XTEN polypeptides wherein the length of the XTEN sequences are chosen based on the property or function to be achieved. Depending on the intended property or function, the aaT-XTEN compositions comprise short or intermediate length XTEN and/or longer XTEN sequences that can serve as carriers. The subject aaT-XTEN encompass XTEN or fragments of XTEN with lengths of about 6, or about 12, or about 36, or about 40, or about 100, or about 144, or about 288, or about 401, or about 500, or about 600, or about 700, or about 800, or about 900, or about 1000, or about 1500, or about 2000, or about 2500, or up to about 3000 amino acid residues in length. In other cases, the XTEN sequences can be about 6 to about 50, or about 100 to 150, about 150 to 250, about 250 to 400, about 400 to about 500, about 500 to 900, about 900 to 1500, about 1500 to 2000, or about 2000 to about 3000 amino acid residues in length. In the embodiments of the aaT-XTEN, the one or more XTEN or fragments of XTEN sequences individually exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a motif or an XTEN selected from Table 4, or a fragment thereof with comparable length. In some embodiments, the aaT-XTEN fusion proteins comprise a first and at least a second XTEN sequence, wherein the cumulative length of the residues in the XTEN sequences is greater than about 100 to about 3000 amino acid residues and the XTEN can be identical or they can be different in sequence or in length. As used herein, "cumulative length" is intended to encompass the total length, in amino acid residues, when more than one XTEN is incorporated into the aaT-XTEN fusion protein. In one embodiment of the foregoing, the first and at least the second sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to one or more XTEN sequences from Table 4, or fragments thereof.

As described more fully below, methods are disclosed in which the aaT-XTEN is designed by selecting the length of the XTEN to confer a target half-life or other physicochemical property on a fusion protein administered to a subject. When XTEN are used as a carrier, the invention takes advantage of the discovery that increasing the length of the non-repetitive, unstructured polypeptides enhances the unstructured nature of the XTENs and correspondingly enhances the biological and pharmacokinetic properties of fusion proteins comprising the XTEN carrier. As described more fully in the Examples, proportional increases in the length of the XTEN, even if created by a repeated order of single family sequence motifs (e.g., the four AE motifs of Table 3), result in a sequence with a higher percentage of random coil formation, as determined by GOR algorithm, or reduced content of alpha-helices or beta-sheets, as determined by Chou-Fasman algorithm, compared to shorter XTEN lengths. In addition, increasing the length of the unstructured polypeptide fusion partner, as described in the Examples, results in a fusion protein with a disproportionate increase in terminal half-life compared to fusion proteins with unstructured polypeptide partners with shorter sequence lengths. In general, XTEN cumulative lengths longer that about 400 residues incorporated into the aaT-XTEN compositions result in longer half-life compared to shorter cumulative lengths; e.g., shorter than about 280 residues.

In some embodiments, where the XTEN serve primarily as a carrier, the invention encompasses aaT-XTEN compositions comprising one or more XTEN wherein the cumulative XTEN sequence length of the fusion protein(s) is greater than about 100, 200, 400, 500, 600, 800, 900, or 1000 to about 3000 amino acid residues, wherein the fusion protein exhibits enhanced pharmacokinetic properties when administered to a subject compared to an aaT not linked to the XTEN and administered at a comparable dose. In one embodiment of the foregoing, the one or more XTEN sequences exhibit at least about 80%, 90%, 91%, 92%, 93%, 94%, 95%, 96%, 97%, or 98% or more identity to a sequence selected from Table 4, and the remainder of the carrier sequence(s) contain at least 90% hydrophilic amino acids and less than about 2% of the overall sequence consists of hydrophobic or aromatic amino acids or cysteine. The enhanced pharmacokinetic properties of the aaT-XTEN in comparison to aaT not linked to XTEN are described more fully, below.

4. XTEN Segments

In one aspect, the invention provides XTEN of short or intermediate lengths, wherein the choice of the XTEN confers different functions or properties to the aaT-XTEN fusion proteins. In particular aaT-XTEN configuration designs, where the XTEN serve as a flexible linker, or are designed to interfere with clearance receptors for aaT, or where a short or intermediate length of XTEN is used to facilitate tissue penetration or to vary the strength of interactions of the aaT-XTEN fusion protein with its target, or where it is desirable to distribute the cumulative length of XTEN in at least two segments of short or intermediate length, the invention provides aaT-XTEN comprising one or more truncated XTEN sequences.

The XTEN of short or intermediate lengths can be an XTEN or a fragment of an XTEN of a length of from about 6 amino acids to about 600 amino acids, or about 12 to about 288 amino acids, or about 36 to about 144 amino acids, or about 42 to about 96 amino acids in length. Non-limiting examples of short or intermediate length XTEN are presented in Table 4, but can also include fragments of the motifs of Table 3 or fragments of the sequences of Table 4 used singly or linked in combination using the methods disclosed herein to achieve an XTEN of a given length, including lengths encompassed by the ranges disclosed above. In non-limiting examples, as schematically depicted in FIGS. 3A-C, the AG864 sequence of 864 amino acid residues can be truncated to yield an AG144 with 144 residues, an AG288 with 288 residues, an AG576 with 576 residues, or other intermediate lengths, while the AE864 sequence (FIGS. 3D-E) can be truncated to yield an AE288 or AE576 or other intermediate lengths. It is specifically contemplated that such an approach can be utilized with any of the XTEN embodiments described herein or with any of the sequences listed in Table 4 to result in XTEN of a desired length.

In another aspect, the invention provides XTEN of longer lengths wherein the sequence is substantially non-repetitive. The incorporation of longer length XTEN as carriers into aaT-XTEN confers enhanced properties on the fusion proteins compared to fusion partners of shorter length XTEN, including slower rates of systemic absorption, increased bioavailability, and increased half-life after subcutaneous or intramuscular administration to a subject, and longer terminal half-life or area under the curve. In one embodiment, the XTEN of longer lengths have greater than about 400, 600, 900, 1000, 1100, 1200, 1300, 1400, 1500, 1600, 1700, 1800, or 2000, up to about 3000 amino acid residues or more in length, wherein the assembled XTEN is substantially non-repetitive.

In some embodiments, the aaT-XTEN fusion protein comprises at least two XTEN segments in which the XTEN segments can be identical or they can be different wherein the cumulative length of the XTEN components are greater than about 100 to about 3000 amino acid residues and comprises at least one sequence segment of at least about 36 to about 923, or at least about 42 to about 875, or at least about 96 to about 576, or at least about 100 to about 288, or at least about 132 to about 144 amino acid residues wherein the sequence segment(s) consists of at least four, or at least five, or at least six different types of amino acids and the sum of glycine (G), alanine (A), serine (S), threonine (T), glutamate (E) and proline (P) residues in the sequence segment(s) constitutes at least about 80%, 85%, 90%, 91%, 92%, 93%, 94%, 95%, 96%, 97%, or 98%, or 99% of the total amino acid sequence of the sequence segment and at least about 90%, 91%, 92%, 93%, 94%, 95%, 96%, 97%, or 98% of the remainder of the XTEN sequence(s) consist of hydrophilic amino acids and less than about 2% of the remainder of the XTEN sequence(s) consists of hydrophobic or aromatic amino acids, or cysteine. In another embodiment, the invention provides an isolated aaT-XTEN fusion protein wherein the cumulative length of the XTEN component is greater than about 100 to about 3000 amino acid residues and comprises at least one sequence segment of at least about 36 to about 923, or at least about 42 to about 875, or at least about 96 to about 576, or at least about 100 to about 288, or at least about 132 to about 144 amino acid residues wherein the sequence segment(s) the sum of glycine (G), alanine (A), serine (S), threonine (T), glutamate (E) and proline (P) residues in the sequence segment(s) constitutes at least about 90%, 91%, 92%, 93%, 94%, 95%, 96%, 97%, 98%, or 99% of the total amino acid sequence of the sequence segment and wherein the subsequence score of a segment or the cumulative segments is less than 10, or less than 9, or less than 8, or less than 7, or less than 6, or less than 5, and at least about 90%, 91%, 92%, 93%, 94%, 95%, 96%, 97%, or 98% of the remainder of the XTEN sequence(s) consist of hydrophilic amino acids and less than about 2% of the remainder of the XTEN sequence(s) consists of hydrophobic, aromatic or cysteine amino acids.

5. N-Terminal XTEN Expression-Enhancing Sequences

In some embodiments, the invention provides a short-length XTEN sequence incorporated as the N-terminal portion of the aaT-XTEN fusion protein. It has been discovered that the expression of the fusion protein is enhanced in a host cell transformed with a suitable expression vector comprising an optimized N-terminal leader polynucleotide sequence (that encodes the N-terminal XTEN) incorporated into the polynucleotide encoding the binding fusion protein. As described in Examples 14-17, a host cell transformed with such an expression vector comprising an optimized N-terminal leader sequence (NTS) in the binding fusion protein gene results in greatly-enhanced expression of the fusion protein compared to the expression of a corresponding fusion protein from a polynucleotide not comprising the NTS, and obviates the need for incorporation of a non-XTEN leader sequence used to enhance expression. In one embodiment, the invention provides aaT-XTEN fusion proteins comprising an NTS wherein the expression of the binding fusion protein from the encoding gene in a host cell is enhanced about 50%, or about 75%, or about 100%, or about 150%, or about 200%, or about 400% compared to expression of a aaT-XTEN fusion protein not comprising the N-terminal XTEN sequence (where the encoding gene lacks the NTS).

In one embodiment, the N-terminal XTEN polypeptide of the aaT-XTEN comprises a sequence that exhibits at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, more preferably at least 99%, or exhibits 100% sequence identity compared to the amino acid sequence of AE48 or AM48, the respective amino acid sequences of which are as follows:

AE48: MAEPAGSPTSTEEGTPGSG-TASSSPGSSTPSGATGSPGASPGTSSTGS (SEQ ID NO: 156)

AM48: MAEPAGSPTSTEEGASPGTSSTG-SPGSSTPSGATGSPGSSTPSGATGS (SEQ ID NO: 157)

In another embodiment, the short-length N-terminal XTEN is linked to an XTEN of longer length to form the N-terminal region of the aaT-XTEN fusion protein, wherein the polynucleotide sequence encoding the short-length N-terminal XTEN confers the property of enhanced expression in the host cell, and wherein the long length of the expressed XTEN contributes to the enhanced properties of the XTEN carrier in the fusion protein, as described above. In the foregoing, the short-length XTEN is linked to any of the XTEN disclosed herein (e.g., an XTEN of Table 4) and the resulting XTEN, in turn, is linked to the N-terminal of any of the aaT disclosed herein (e.g., an aaT of Table 1 or a sequence variant or fragment thereof) as a component of the fusion protein. Alternatively, polynucleotides encoding the short-length XTEN (or its complement) is linked to polynucleotides encoding any of the XTEN (or its complement) disclosed herein and the resulting gene encoding the N-terminal XTEN, in turn, is linked to the 5' end of polynucleotides encoding any of the aaT (or to the 3' end of its complement) disclosed herein. In some embodiments, the N-terminal XTEN polypeptide with long length exhibits at least about 80%, or at least about 90%, or at least about 91%, or at least about 92%, or at least about 93%, or at least about 94%, or at least about 95%, or at least about 96%, or at least about 97%, or at least about 98%, or at least about 99%, or exhibits 100% sequence identity compared to an amino acid sequence selected from the group consisting of the sequences AE624, AE912, and AM923.

In any of the foregoing N-terminal XTEN embodiments described above, the N-terminal XTEN can have from about one to about six additional amino acid residues, preferably selected from glycine, serine, threonine, glutamate, proline and alanine, to accommodate the endonuclease restriction sites that is employed to join the nucleotides encoding the N-terminal XTEN to the gene encoding the targeting moiety of the fusion protein. Non-limiting examples of amino acids compatible with the restrictions sites and the preferred amino acids are listed in Table 5, below. The methods for the generation of the N-terminal sequences and incorporation into the fusion proteins of the invention are described more fully in the Examples.

6. Net Charge

In other embodiments, the XTEN polypeptides have an unstructured characteristic imparted by incorporation of amino acid residues with a net charge and containing a low proportion or no hydrophobic amino acids in the XTEN sequence. The overall net charge and net charge density is controlled by modifying the content of charged amino acids in the XTEN sequences, either positive or negative, with the net charge typically represented as the percentage of amino acids in the polypeptide contributing to a charged state beyond those residues that are cancelled by a residue with an opposing charge. In some embodiments, the net charge density of the XTEN of the compositions may be above +0.1 or below −0.1 charges/residue. By "net charge density" of a protein or peptide herein is meant the net charge divided by the total number of amino acids in the protein or propeptide. In other embodiments, the net charge of an XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more. In some embodiments, the XTEN sequence comprises charged residues separated by other residues such as serine or glycine, which leads to better expression or purification behavior. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In one embodiment, the XTEN will have an isoelectric point between 1.5 and 4.5 and carry a net negative charge under physiologic conditions.

Since most tissues and surfaces in a human or animal have a net negative charge, in some embodiments, the XTEN sequences are designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. In preferred embodiments, the negative charge of the subject XTEN is conferred by incorporation of glutamic acid residues. For example, where an XTEN with a negative charge is desired, the XTEN can be selected solely from an AE family sequence, which has approximately a 17% net charge due to incorporated glutamic acid, or can include varying proportions of glutamic acid-containing motifs of Table 3 to provide the desired degree of net charge. Non-limiting examples of AE XTEN include, but are not limited to the AE36, AE42, AE48, AE144, AE288, AE576, AE624, AE864, and AE912 polypeptide sequences of Tables 4 or 9, or fragments thereof. In one embodiment, an XTEN sequence of Tables 4 or 9 can be modified to include additional glutamic acid residues to achieve the desired net negative charge. Accordingly, in one embodiment the invention provides XTEN in which the XTEN sequences contain about 1%, 2%, 4%, 8%, 10%, 15%, 17%, 20%, 25%, or even about 30% glutamic acid. Generally, the glutamic residues are spaced uniformly across the XTEN sequence. In some cases, the XTEN can contain about 10-80, or about 15-60, or about 20-50 glutamic residues per 20kDa of XTEN that can result in an XTEN with charged residues that would have very similar pKa, which can increase the charge homogeneity of the product and sharpen its isoelectric point, enhance the physicochemical properties of the resulting aaT-XTEN fusion protein for, and hence, simplifying purification procedures. In one embodiment, the invention contemplates incorporation of aspartic acid residues into XTEN in addition to glutamic acid in order to achieve a net negative charge.

In other cases, where no net charge is desired, the XTEN can be selected from, for example, AG XTEN components, such as the AG motifs of Table 3, or those AM motifs of Table 3 that have approximately no net charge. Non-limiting examples of AG XTEN include, but are not limited to AG42, AG144, AG288, AG576, and AG864 polypeptide sequences of Tables 4 and 11, or fragments thereof. In another embodiment, the XTEN can comprise varying proportions of AE and AG motifs (in order to have a net charge that is deemed optimal for a given use or to maintain a given physicochemical property.

Not to be bound by a particular theory, the XTEN of the aaT-XTEN compositions with the higher net charge are expected to have less non-specific interactions with various negatively-charged surfaces such as blood vessels, tissues, or various receptors, which would further contribute to reduced active clearance. Conversely, it is believed that the XTEN of the aaT-XTEN compositions with a low (or no) net charge would have a higher degree of interaction with surfaces that can potentiate the activity of the associated aaT, given the known contribution of phagocytic cells in the inflammatory process in the lung.

The XTEN of the compositions of the present invention generally have no or a low content of positively charged amino acids. In some embodiments, the XTEN may have less than about 10% amino acid residues with a positive charge, or less than about 7%, or less than about 5%, or less than about 2%, or less than about 1% amino acid residues with a positive charge. However, the invention contemplates constructs where a limited number of amino acids with a positive charge, such as lysine, are incorporated into XTEN to permit conjugation between the epsilon amine of the lysine and a reactive group on a peptide, a linker bridge, or a reactive group on a drug or small molecule to be conjugated to the XTEN backbone. In one embodiment of the foregoing, the XTEN has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or alternatively only a single lysine residue. Using the foregoing lysine-containing XTEN, fusion proteins are constructed that comprises XTEN, an aaT, plus a chemotherapeutic agent useful in the treatment of aaT-related diseases or disorders, wherein the maximum number of molecules of the agent incorporated into the XTEN component is determined by the numbers of lysines or other amino acids with reactive side chains (e.g., cysteine) incorporated into the XTEN.

As hydrophobic amino acids impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of an aaT-XTEN fusion protein is typically less than 5%, or less than 2%, and most preferably less than 1%. In another embodiment, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

7. Low Immunogenicity

In another aspect, the invention provides compositions in which the XTEN sequences have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or the activation of a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity is achieved by designing XTEN sequences that resist antigen processing in antigen presenting cells, and/or choosing sequences that do not bind MHC receptors well. The invention provides aaT-XTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity can attribute to, at least in part, a result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and also reduce the immunogenicity of the aaT fusion partner in the aaT-XTEN compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods*, 281: 95-108). Of particular interest are peptide sequences that can be oligomerized without generating T cell epitopes or non-human sequences. This is achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some embodiments, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 34. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{-10}$ $K_d$), and can be reduced by avoiding hydrophobic amino acids that serve as anchor residues during peptide display on MHC, such as M, I, L, V, F. In some embodiments, an XTEN component incorporated into an aaT-XTEN does not have a predicted T-cell epitope at a TEPITOPE threshold score of about −5, or −6, or −7, or −8, or −9, or at a TEPITOPE score of −10. As used herein, a score of "−9" would be a more stringent TEPITOPE threshold than a score of −5.

In another embodiment, the inventive XTEN sequences, including those incorporated into the subject aaT-XTEN fusion proteins, are rendered substantially non-immunogenic by the restriction of known proteolytic sites from the sequence of the XTEN, reducing the processing of XTEN into small peptides that can bind to MHC II receptors. In another embodiment, the XTEN sequence is rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN render the XTEN compositions, including the XTEN of the aaT-XTEN fusion protein compositions, substantially unable to be bound by mammalian receptors, including those of the immune system. In one embodiment, an XTEN of an aaT-XTEN fusion protein can have >100 nM $K_d$ binding to a mammalian receptor, or greater than 500 nM $K_d$, or greater than 1 µM $K_d$ towards a mammalian cell surface or circulating polypeptide receptor.

Additionally, the non-repetitive sequence and corresponding lack of epitopes of XTEN limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while a XTEN can make contacts with many different B cells over its extended sequence, each individual B cell may only make one or a small number of contacts with an individual XTEN due to the lack of repetitiveness of the sequence. Not being to be bound by any theory, XTENs typically have a much lower tendency to stimulate proliferation of B cells and thus an immune response. In one embodiment, the aaT-XTEN have reduced immunogenicity as compared to the corresponding aaT that is not fused to an XTEN. In one embodiment, the administration of up to three parenteral doses of an aaT-XTEN to a mammal result in detectable anti-aaT-XTEN IgG at a serum dilution of 1:100 but not at a dilution of 1:1000. In another embodiment, the administration of up to three parenteral doses of an aaT-XTEN to a mammal result in detectable anti-aaT IgG at a serum dilution of 1:100 but not at a dilution of 1:1000. In another embodiment, the administration of up to three parenteral doses of an aaT-XTEN to a mammal result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of XTENs with non-repetitive sequences relative to sequences with a high degree of repetitiveness is non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the aaT-XTEN compositions can remain in circulation for an increased period of time.

8. Increased Hydrodynamic Radius

In another aspect, the present invention provides XTEN in which the XTEN polypeptides have a high hydrodynamic radius that confers a corresponding increased apparent molecular weight to the aaT-XTEN fusion protein incorporating the XTEN. As detailed in Example 28, the linking of XTEN to therapeutic protein sequences results in aaT-XTEN compositions that can have increased hydrodynamic radii, increased apparent molecular weight, and increased apparent molecular weight factor compared to a therapeutic protein not linked to an XTEN. For example, in therapeutic applications in which prolonged half-life is desired, compositions in which a XTEN with a high hydrodynamic radius is incorporated into a fusion protein comprising a therapeutic protein can effectively enlarge the hydrodynamic radius of the composition beyond the glomerular pore size of approximately 3-5 nm (corresponding to an apparent molecular weight of about 70 kDA) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins with a corresponding increase in terminal half-life and other enhanced pharmacokinetic properties. The hydrodynamic radius of a protein is determined by its molecular weight as well as by its structure, including shape or compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Ser. Nos. 6,406,632 and 7,294,513. As the results of Example 28 demonstrate, the addition of increasing lengths of XTEN results in proportional increases in the parameters of hydrodynamic radius, apparent molecular weight, and apparent molecular weight factor, permitting the tailoring of aaT-XTEN to desired characteristic cut-off apparent molecular weights or hydrodynamic radii. Accordingly, in certain embodiments, the aaT-XTEN fusion protein can be configured with an XTEN such that the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by the XTEN in an aaT-XTEN fusion protein can lead to reduced renal clearance of the resulting fusion protein, leading to a corresponding increase in terminal half-life, an increase in mean residence time, and/or a decrease in renal clearance rate.

When the molecular weights of the aaT-XTEN fusion proteins are derived from size exclusion chromatography analyses, the open conformation of the XTEN due to the low degree of secondary structure results in an increase in the apparent molecular weight of the fusion proteins. In some embodiments the aaT-XTEN comprising a aaT and at least a first or multiple XTEN exhibits an apparent molecular weight of at least about 200 kDa, or at least about 400 kDa, or at least about 500 kDa, or at least about 700 kDa, or at least about 1000 kDa, or at least about 1400 kDa, or at least about 1600 kDa, or at least about 1800 kDa, or at least about 2000 kDa., or at least about 3000 kDa. Accordingly, the aaT-XTEN fusion proteins comprising one or more XTEN exhibit an apparent molecular weight that is about 1.3-fold greater, or about 2-fold greater, or about 3-fold greater or about 4-fold greater, or about 8-fold greater, or about 10-fold greater, or about 12-fold greater, or about 15-fold greater, or about 20-fold greater than the actual molecular weight of the fusion protein. In one embodiment, the isolated aaT-XTEN fusion protein of any of the embodiments disclosed herein exhibit an apparent molecular weight factor under physiologic conditions that is greater than about 1.3, or about 2, or about 3, or about 4, or about 5, or about 6, or about 7, or about 8, or about 10, or about 15, or greater than about 20. In another embodiment, the aaT-XTEN fusion protein has, under physiologic conditions, an apparent molecular weight factor that is about 3 to about 20, or is about 5 to about 15, or is about 8 to about 12, or is about 9 to about 10 relative to the actual molecular weight of the fusion protein.

IV). aaT-XTEN Compositions

The present invention relates in part to fusion protein compositions comprising alpha 1-antitrypsin and XTEN, wherein the fusion protein would act to replace or augment existing aaT. A major problem to which the invention is directed is to achieve an increase in circulation (terminal) half-life of exogenously administered alpha 1-antitrypsin to a subject in need thereof. One way to increase the circulation half-life of a therapeutic protein is to ensure that renal clearance of the protein is reduced. Another way to increase the circulation half-life is to reduce the active clearance of the therapeutic protein, whether mediated by receptors, active metabolism of the protein, or other endogenous mechanisms. Both may be achieved by conjugating the protein to a polymer, which, in some cases, is capable of conferring an increased molecular size (or hydrodynamic radius) to the protein and, hence, reduced renal clearance, and, in other cases, interferes with binding of the protein to clearance receptors or other proteins that contribute to metabolism or clearance. Thus, certain objects of the present invention include, but are not limited to, providing improved aaT molecules with a longer circulation or terminal half-life, decreasing the number or frequency of necessary administrations of aaT compositions, retaining at least a portion of the activity of the native alpha 1-antitrypsin, and enhancing the ability to treat aaT deficiencies and resulting impact on pulmonary function more efficiently, more effectively, more economically, and with greater safety compared to presently available alpha 1-antitrypsin preparations.

To meet these needs, in a first aspect, the invention provides isolated fusion protein compositions comprising a biologically active aaT covalently linked to one or more XTEN, resulting in an aaT-XTEN fusion protein composition. The term "aaT-XTEN", as used herein, is meant to encompass fusion polypeptides that comprise one or more payload regions comprising a biologically active aaT or a portion of a aaT that mediates one or more biological or therapeutic activities associated with an aaT and at least one other region comprising at least a first XTEN polypeptide. In one embodiment, the aaT is native aaT. In another embodiment, the aaT is a sequence variant, fragment, homolog, or mimetic of a natural sequence that retain at least a portion of the biological activity of the native aaT, as disclosed above (including sequences with homology to the sequences of Table 1). Activity of the aaT-XTEN fusion protein can be assessed as the ability of the protein to inhibit a protease, such as trypsin or other serine proteases; e.g., elastase, using assays such as those of Example 23 or the assays of Table 39. As aaT is a non-competitive inhibitor, a useful parameter to assess the activity is the $IC_{50}$ value towards a substrate ligand such as trypsin. In one embodiment, the aaT-XTEN fusion protein of the present invention has an $IC_{50}$ value of less than about 10 µM, or about 3 µM, or about 1 µM, or about 0.30 µM, or about 0.10 µM, or about 0.03 µM, with trypsin as the substrate. In another embodiment, the fusion protein exhibits at least about 20%, or 30%, or 40%, or 50%, or 60%, or 70%, or 80%, or at least about 90% of the trypsin inhibitory activity compared to the corresponding alpha 1-antitrypsin component not linked to the XTEN. In another embodiment, the fusion protein exhibits at least about 20%, or 30%, or 40%, or 50%, or 60%, or 70%, or 80%, or at least about 90% of the trypsin inhibitory activity compared to plasma-derived alpha 1-antitrypsin.

The compositions of the invention include fusion proteins that are useful, when administered to a subject, for mediating or preventing or ameliorating a disease, disorder or condition associated with alpha 1-antitrypsin deficiencies or defects in endogenously produced aaT, or disorders associated with alpha 1-antitrypsin deficiencies or defects. Of particular interest are aaT-XTEN fusion protein compositions for which an increase in a pharmacokinetic parameter, increased solubility, increased stability, or some other enhanced pharmaceutical property compared to native aaT is obtained, providing compositions with enhanced efficacy, safety, or that result in reduced dosing frequency and/or improve patient management. The aaT-XTEN fusion proteins of the embodiments disclosed herein exhibit one or more or any combination of the improved properties and/or the embodiments as detailed herein. Thus, the subject aaT-XTEN fusion protein compositions are designed and prepared with various objectives in mind, including improving the therapeutic efficacy of the bioactive aaT by, for example, increasing the in vivo exposure or the length that the aaT-XTEN remains within the therapeutic window when administered to a subject, compared to an aaT not linked to XTEN.

The aaT of the subject compositions, particularly those disclosed in Table 1, together with their corresponding nucleic acid and amino acid sequences, are well known in the art and descriptions and sequences are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences may be a wild type polynucleotide sequence encoding a given aaT (e.g., either full length or mature), or in some instances the sequence may be a variant of the wild type polynucleotide sequence (e.g., a polynucleotide which encodes the wild type biologically active protein, wherein the DNA sequence of the polynucleotide has been optimized, for example, for expression in a particular species; or a polynucleotide encoding a variant of the wild type protein, such as a site directed mutant or an allelic variant. It is well within the ability of the skilled artisan to use a wild-type or consensus cDNA sequence or a codon-optimized variant of a aaT to create aaT-XTEN constructs contemplated by the invention using methods known in the art and/or in conjunction with the guidance and methods provided herein, and described more fully in the Examples.

In one embodiment, an aaT-XTEN fusion protein comprises a single aaT molecule linked to a single XTEN (e.g., an XTEN as described above). In another embodiment, the aaT-XTEN comprises a single aaT linked to two XTEN, wherein the XTEN may be identical or they may be different. In another embodiment, the aaT-XTEN fusion protein comprises a single aaT molecule linked to a first and a second XTEN, in which the aaT is a sequence that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to a protein sequence selected from Table 1, and the first and the second XTEN are each sequences that have at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to one or more sequences selected from Table 4, or fragments thereof. In yet another embodiment, the aaT-XTEN fusion protein comprises a sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a sequence from Table 40 and 41.

1. aaT-XTEN Fusion Protein Configurations

The invention provides aaT-XTEN fusion protein compositions with the aaT and XTEN components linked in specific N- to C-terminus configurations.

In one embodiment of the aaT-XTEN composition, the invention provides a fusion protein of formula I:

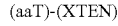

wherein independently for each occurrence, aaT is a alpha 1-antitrypsin as defined herein and XTEN is an extended recombinant polypeptide as defined herein.

In another embodiment of the aaT-XTEN composition, the invention provides a fusion protein of formula II:

                                                        II wherein independently for each occurrence, aaT is an alpha 1-antitrypsin as defined herein and XTEN is an extended recombinant polypeptide as defined herein.

In another embodiment of the aaT-XTEN composition, the invention provides an isolated fusion protein, wherein the fusion protein is of formula III:

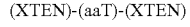                                                        III wherein independently for each occurrence, aaT is an alpha 1-antitrypsin as defined herein and XTEN is an extended recombinant polypeptide as defined herein.

In another embodiment of the aaT-XTEN composition, the invention provides an isolated fusion protein, wherein the fusion protein is of formula IV:

                                                        IV wherein independently for each occurrence, aaT is an alpha 1-antitrypsin as defined herein and XTEN is an extended recombinant polypeptide as defined herein.

In another embodiment of the aaT-XTEN composition, the invention provides an isolated fusion protein, wherein the fusion protein is of formula V:

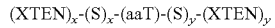                                                        V wherein independently for each occurrence, aaT is an alpha 1-antitrypsin as defined herein; S is a spacer sequence having between 1 to about 50 amino acid residues that can optionally include a cleavage sequence or amino acids compatible with restrictions sites; x is either 0 or 1 and y is either 0 or 1 wherein x+y>1; and XTEN is an extended recombinant polypeptide as defined herein.

The embodiments of formulae I-V encompass aaT-XTEN configurations wherein one or more XTEN of lengths ranging from about 36 amino acids to 3000 amino acids (e.g., sequences selected from Table 4 or fragments thereof, or sequences exhibiting at least about 90-95% or more sequence identity thereto) are linked to the N- or C-terminus of the aaT. The embodiments of formula V further provide configurations wherein the XTEN are linked to aaT via spacer sequences that can optionally comprise amino acids compatible with restrictions sites or can include cleavage sequences (e.g., the sequences of Tables 5 and 6, described more fully below) such that the XTEN encoding sequence can be, in the case of a restriction site, be integrated into an aaT-XTEN construct and, in the case of a cleavage sequence, the XTEN can be released from the fusion protein by the action of a protease appropriate for the cleavage sequence.

2. aaT-XTEN Fusion Protein Configurations with Spacer and Cleavage Sequences

In another aspect, the invention provides aaT-XTEN configured with one or more spacer sequences incorporated into or adjacent to the XTEN that are designed to incorporate or enhance a functionality or property to the composition, or as an aid in the assembly or manufacture of the fusion protein compositions. Such properties include, but are not limited to, inclusion of cleavage sequence(s) to permit release of components, inclusion of amino acids compatible with nucleotide restrictions sites to permit linkage of XTEN-encoding nucleotides to aaT-encoding nucleotides or that facilitate construction of expression vectors, and linkers designed to reduce steric hindrance in regions of aaT-XTEN fusion proteins.

A spacer sequence can be introduced between an XTEN sequence and an aaT component to decrease steric hindrance such that the aaT component may assume its desired tertiary structure and/or interact appropriately with its target substrate or processing enzyme. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L amino acids, and will preferably have XTEN-like properties in that 1) they will comprise hydrophilic amino acids that are sterically unhindered such as, but not limited to, glycine (G), alanine (A), serine (S), threonine (T), glutamate (E), proline (P) and aspartate (D); and 2) will be substantially non-repetitive. In some cases, the spacer can be polyglycines or polyalanines, or is predominately a mixture of combinations of glycine, serine and alanine residues. In one embodiment, a spacer sequence, exclusive of cleavage site amino acids, has about 1 to 10 amino acids that consist of amino acids selected from glycine (G), alanine (A), serine (S), threonine (T), glutamate (E), and proline (P) and are substantially devoid of secondary structure; e.g., less than about 10%, or less than about 5% as determined by the Chou-Fasman and/or GOR algorithms. In one embodiment, the spacer sequence is GPEGPS (SEQ ID NO: 827). In another embodiment, the spacer sequence is GPEGPS (SEQ ID NO: 827) linked to a cleavage sequence of Table 6. In addition, spacer sequences are designed to avoid the introduction of T-cell epitopes; determination of which are described above and in the Examples.

In one embodiment, the aaT-XTEN fusion protein comprises one or more spacer sequences linked at the junction(s) between the payload aaT sequence and the one more XTEN incorporated into the fusion protein, wherein the spacer sequences comprise amino acids that are compatible with nucleotides encoding restriction sites. In another embodiment, the aaT-XTEN fusion protein comprises one or more spacer sequences linked at the junction(s) between the payload aaT sequence and the one more XTEN incorporated into the fusion protein wherein the spacer sequences comprise amino acids that are compatible with nucleotides encoding restriction sites and the amino acids and the one more spacer sequence amino acids are chosen from glycine (G), alanine (A), serine (S), threonine (T), glutamate (E), and proline (P). In another embodiment, the aaT-XTEN fusion protein comprises one or more spacer sequences linked at the junction(s) between the payload aaT sequence and the one more XTEN incorporated into the fusion protein wherein the spacer sequences comprise amino acids that are compatible with nucleotides encoding restriction sites and the one more spacer sequences are chosen from the sequences of Table 5. The exact sequence of each spacer sequence is chosen to be compatible with cloning sites in expression vectors that are used for a particular aaT-XTEN construct. For embodiments in which a single XTEN is attached to the N- or C-terminus, only a single spacer sequence at the junction of the two components would be required. As would be apparent to one of ordinary skill in the art, the spacer sequences comprising amino acids compatible with restriction sites could be omitted from the construct when an entire aaT-XTEN gene is synthetically generated, rather than ligated using aaT and XTEN encoding genes.

TABLE 5

Spacer Sequences Compatible with Restriction Sites

| Spacer Sequence | SEQ ID NO: | Restriction Enzyme |
|---|---|---|
| GSPG | 158 | BsaI |
| ETET | 159 | BsaI |
| PGSSS | 160 | BbsI |
| GAP | | AscI |
| GPA | | FseI |
| GPSGP | 161 | SfiI |
| AAA | | SacII |
| TG | | AgeI |
| GT | | KpnI |

In some embodiments, a spacer sequence in an aaT-XTEN fusion protein composition comprises one or more cleavage sequences, which are identical or different, wherein the cleavage sequence may be acted on by a protease to release the XTEN sequence(s) from the fusion protein. In one embodiment, the incorporation of the cleavage sequence into the aaT-XTEN is designed to permit release of an aaT that becomes active or more active upon its release from the XTEN component. The cleavage sequences are located sufficiently close to the aaT sequences, generally within 18, or within 12, or within 6, or within 2 amino acids of the aaT sequence, such that any remaining residues attached to the aaTs after cleavage do not appreciably interfere with the activity (e.g., such as binding to a target protease) of the aaT, yet provide sufficient access to the protease to be able to effect cleavage of the cleavage sequence. In some cases, the aaT-XTEN comprising the cleavage sequences will also have one or more spacer sequence amino acids between the aaT and the cleavage sequence or the XTEN and the cleavage sequence to facilitate access of the protease to the cleavage sequence; the spacer amino acids comprising any natural amino acid, including glycine, serine and alanine as preferred amino acids. In one embodiment, the cleavage site is a sequence that can be cleaved by a protease endogenous to the mammalian subject such that the aaT-XTEN can be cleaved after administration to a subject. In such case, the aaT-XTEN can serve as a prodrug or a circulating depot for the aaT. In a particular construct of the foregoing, the aaT-XTEN would have one or two XTEN linked to the N- and/or the C-terminus such that the XTEN could be released, leaving the active form of aaT free. In one embodiment of the foregoing construct, the aaT that is released from the fusion protein by cleavage of the cleavage sequence exhibits at least about a two-fold, or at least about a three-fold, or at least about a four-fold, or at least about a five-fold, or at least about a six-fold, or at least about a eight-fold, or at least about a ten-fold, or at least about a 20-fold increase in activity compared to the intact aaT-XTEN fusion protein.

Examples of cleavage sites contemplated by the invention include, but are not limited to, a polypeptide sequence cleavable by a mammalian endogenous protease selected from FXIa, FXIIa, kallikrein, FVIIIa, FVIIIa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases and others are known in the art. Exemplary cleavage sequences contemplated by the invention and the respective cut sites within the sequences are presented in Table 6, as well as sequence variants thereof.

Thus, cleavage sequences, particularly those of Table 6 that are susceptible to the endogenous proteases present during inflammation, would provide for release of aaT that, in certain embodiments of the aaT-XTEN, provide a higher degree of activity for the aaT component released from the intact form of the aaT-XTEN, as well as additional safety margin for high doses of aaT-XTEN administered to a subject. In one embodiment, the invention provides aaT-XTEN comprising one or more cleavage sequences operably positioned to release the aaT from the fusion protein upon cleavage, wherein the one or more cleavage sequences has at least about 86%, or at least about 92% or greater sequence identity to a sequence selected from Table 6. In another embodiment, the aaT-XTEN comprising a cleavage sequence would have at least about 80%, or at least about 85%, or at least about 90%, or at least about 95%, or at least about 96%, or at least about 97%, or at least about 98%, or at least about 99% sequence identity compared to a sequence selected from Table 41.

In some embodiments, only the two or three amino acids flanking both sides of the cut site (four to six amino acids total) are incorporated into the cleavage sequence that, in turn, is incorporated into the aaT-XTEN of the embodiments. In other embodiments, the incorporated cleavage sequence of Table 6 can have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the aaT from the XTEN. Exemplary substitutions are shown in Table 6.

TABLE 6

Protease Cleavage Sequences

| Protease Acting Upon Sequence | Exemplary Cleavage Sequence | SEQ ID NO: | Minimal Cut Site* | SEQ ID NO: |
|---|---|---|---|---|
| FXIa | KLTR↓AET | 162 | KD/FL/T/R↓VA/VE/GT/GV | |
| FXIa | DFTR↓VVG | 163 | KD/FL/T/R↓VA/VE/GT/GV | |
| FXIIa | TMTR↓IVGG | 164 | NA | |
| Kallikrein | SPFR↓STGG | 165 | −/−/FL/RY↓SR/RT/−/− | |
| FVIIa | LQVR↓IVGG | 166 | NA | |
| FIXa | PLGR↓IVGG | 167 | −/−/G/R↓−/−/−/− | |
| FXa | IEGR↓TVGG | 168 | IA/E/GFP/R↓STI/VFS/−/G | |
| FIIa (thrombin) | LTPR↓SLLV | 169 | −/−/PLA/R↓SAG/−/−/− | |
| Elastase-2 | LGPV↓SGVP | 170 | −/−/−/VIAT↓−/−/−/− | |
| Granzyme-B | VAGD↓SLEE | 171 | V/−/−/D↓−/−/−/− | |
| MMP-12 | GPAG↓LGGA | 172 | G/PA/−/G↓L/−/G/− | 173 |
| MMP-13 | GPAG↓LRGA | 174 | G/P/−/G↓L/−/GA/− | 175 |
| MMP-17 | APLG↓LRLR | 176 | −/PS/−/−↓LQ/−/LT/− | |
| MMP-20 | PALP↓LVAQ | 177 | NA | |
| TEV | ENLYFQ↓G | 178 | ENLYFQ↓G/S | 179 |
| Enterokinase | DDDK↓IVGG | 180 | DDDK↓IVGG | 181 |
| Protease 3C (PreScission ™) | LEVLFQ↓GP | 182 | LEVLFQ↓GP | 183 |
| Sortase A | LPKT↓GSES | 184 | L/P/KEAD/T↓G/−/EKS/S | 185 |

↓ indicates cleavage site
NA: not applicable
*the listing of multiple amino acids before, between, or after a slash indicate alternative amino acids that can be substituted at the position; "−" indicates that any amino acid may be substituted for the corresponding amino acid indicated in the middle column

3. Exemplary aaT-XTEN Fusion Protein Sequences

Non-limiting examples of sequences of fusion proteins containing a single aaT linked to one or two XTEN, either joined at the N- or C-termini are presented in Table 40. In one embodiment, an aaT-XTEN composition would comprise a fusion protein having at least about 80% sequence identity compared to an aaT-XTEN selected from Table 40, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared to an aaT-XTEN from Table 40. However, the invention also contemplates substitution of any of the aaT sequences of Table 1 for an aaT component of the aaT-XTEN of Table 40, and/or substitution of any sequence of Table 4 for an XTEN component of the aaT-XTEN of Table 40. Generally, the resulting aaT-XTEN of the foregoing examples retain at least a portion of the biological activity of the corresponding aaT not linked to the XTEN. In the foregoing fusion proteins hereinabove described in this paragraph, the aaT-XTEN fusion protein can further comprise one or more cleavage sequences; e.g., a sequence from Table 6, the cleavage sequence being located between the aaT and the XTEN. In some embodiments comprising cleavage sequence(s), the intact aaT-XTEN composition has less activity but a longer half-life in its intact form compared to a corresponding aaT not linked to the XTEN, but is designed such that upon administration to a subject, the aaT component is gradually released from the fusion protein by cleavage at the cleavage sequence(s) by endogenous proteases, whereupon the aaT component exhibits activity, i.e., the ability to effectively bind to proteases. In non-limiting examples, the aaT-XTEN with a cleavage sequence has about 80% sequence identity compared to a sequence from Table 41, or about 85%, or about 90%, or about 95%, or about 97%, or about 98%, or about 99% sequence identity compared to a sequence from Table 41. However, the invention also contemplates substitution of any of the aaT sequences of Table 1 for an aaT component of the aaT-XTEN of Table 41, substitution of any sequence of Table 4 for an XTEN component of the aaT-XTEN of Table 41, and substitution of any cleavage sequence of Table 6 for a cleavage component of the aaT-XTEN of Table 41. In some cases, the aaT-XTEN of the foregoing embodiments in this paragraph serve as prodrugs or a circulating depot, resulting in a longer terminal half-life compared to aaT not linked to the XTEN. In such cases, a higher concentration of aaT-XTEN can be administered to a subject to maintain therapeutic blood levels for an extended period of time compared to the corresponding aaT not linked to XTEN because a smaller proportion of the circulating composition is active.

The aaT-XTEN compositions of the embodiments can be evaluated for biological activity using assays or in vivo parameters as described herein (e.g., assays of the Examples or assays of Table 39), or a pharmacodynamic effect in a preclinical model of aaT deficiency or in clinical trials in humans, using methods as described in the Examples or other methods known in the art for assessing aaT activity to determine the suitability of the configuration or the aaT sequence variant, and those aaT-XTEN compositions (including after cleavage of any incorporated XTEN-releasing cleavage sites) that retain at least about 40%, or about 50%, or about 55%, or about 60%, or about 70%, or about 80%, or about 90%, or about 95% or more activity compared to native aaT sequence are considered suitable for use in the treatment of aaT-related diseases, disorder or conditions.

V). Properties of the aaT-XTEN compositions of the invention (a) Pharmacokinetic Properties of aaT-XTEN The invention provides aaT-XTEN fusion proteins with enhanced pharmacokinetics compared to aaT not linked to the XTEN. The pharmacokinetic properties of an aaT that can be enhanced by linking a given XTEN to the aaT include, but are not limited to, terminal half-life, area under the curve (AUC), $C_{max}$, volume of distribution, maintaining the biologically active aaT-XTEN within the therapeutic window above the minimum effective dose or blood unit concentration for a longer period of time compared to the aaT not linked to XTEN, and bioavailability; properties that permits less frequent dosing or an enhanced pharmacologic effect, resulting in enhanced utility in the treatment of alpha 1-antitrypsin-related disorders, diseases and related conditions.

Exogenously administered alpha 1-antitrypsin derived from plasma has been reported to have a terminal half-life in humans of approximately 130-140 hours (Prolastin®C package insert), while a non-glycosylated recombinant form exhibited a beta-half-life of less than 1 hr in rabbits (Travis et al., JBC (1985) 260:4384-4389) and 69 minutes in rhesus monkeys. (Casolaro, M, et al., (1987) 63:2015-2023). It will be understood by the skilled artisan that the pharmacokinetic properties of the aaT-XTEN embodiments are to be compared to comparable forms of alpha 1-antitrypsin not linked to the XTEN, i.e., recombinant, non-glycosylated alpha 1-antitrypsin.

As a result of the enhanced properties conferred by XTEN, the aaT-XTEN, when used at the dose and dose regimen determined to be appropriate for the composition by the methods described herein, can achieve a circulating concentration resulting in a desired pharmacologic or clinical effect for an extended period of time compared to a comparable dose of the corresponding aaT not linked to the XTEN. As used herein, a "comparable dose" means a dose with an equivalent moles/kg for the active aaT pharmacophore (e.g., aaT) that is administered to a subject in a comparable fashion. It will be understood in the art that a "comparable dosage" of aaT-XTEN fusion protein would represent a greater weight of agent but would have essentially the same mole-equivalents of aaT in the dose of the fusion protein administered.

In one embodiment, the invention provides aaT-XTEN with enhanced pharmacokinetic properties wherein the aaT-XTEN is a sequence that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a sequence selected from any one of Table 40 or 41. In other embodiments, the aaT-XTEN with enhanced pharmacokinetic properties comprises an aaT sequence that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or about 99% sequence identity compared to a sequence from Table 1 linked to one or more XTEN that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or about 99% sequence identity compared to a sequence from Table 4. For the subject compositions, aaT-XTEN with a longer terminal half-life is generally preferred, so as to improve patient convenience, to increase the interval between doses and to reduce the amount of drug required to achieve a sustained effect. In the embodiments hereinabove described in this paragraph the administration of the fusion protein results in an improvement in at least one of the parameters disclosed herein as being useful for assessing the subject diseases, conditions or disorders e.g., maintaining a blood concentration, maintaining pulmonary function, preventing onset of a symptom associated with emphysema or COPD, using a lower dose of fusion protein compared to the corresponding aaT component not linked to the fusion protein and administered at a comparable dose or dose regimen to a subject. In the foregoing embodiments, the total dose in millimoles/kg administered to achieve the improvement in at least one parameter is at least about three-fold lower, or at least about four-fold, or at least about five-fold, or at least about six-fold, or at least about eight-fold, or at least about 10-fold lower compared to the corresponding aaT component not linked to the XTEN.

As described more fully in the Examples pertaining to pharmacokinetic characteristics of fusion proteins comprising XTEN, it was observed that increasing the length of the XTEN sequence confers a disproportionate increase in the terminal half-life of a fusion protein comprising the XTEN. Accordingly, the invention provides aaT-XTEN fusion proteins comprising XTEN wherein the XTEN is selected to provide a targeted half-life for the aaT-XTEN composition administered to a subject. In some embodiments, the invention provides monomeric aaT-XTEN fusion proteins comprising XTEN wherein the XTEN is selected to confer an increase in the terminal half-life for the aaT-XTEN administered to a subject, compared to the corresponding aaT not linked to the XTEN and administered at a comparable dose, wherein the increase is at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least a 40-fold or greater an increase in terminal half-life compared to the aaT not linked to the XTEN. In another embodiment, the administration of a therapeutically effective amount of aaT-XTEN to a subject in need thereof results in a terminal half-life that is at least 12 h greater, or at least about 24 h greater, or at least about 48 h greater, or at least about 96 h greater, or at least about 144 h greater, or at least about 7 days greater, or at least about 14 days greater, or at least about 21 days greater compared to a comparable dose of the corresponding aaT not linked to the XTEN. In another embodiment, administration of a therapeutically effective dose of an aaT-XTEN fusion protein to a subject in need thereof can result in a gain in time between consecutive doses necessary to maintain a therapeutically effective blood level of the fusion protein of at least 48 h, or at least 72 h, or at least about 96 h, or at least about 120 h, or at least about 7 days, or at least about 14 days, or at least about 21 days between consecutive doses compared to the corresponding aaT not linked to the XTEN and administered at a comparable dose. It will be understood in the art that the time between consecutive doses to maintain a "therapeutically effective blood level" will vary greatly depending on the physiologic state of the subject, and it will be appreciated that a patient with emphysema or COPD will require more frequent dosing of a alpha 1-antitrypsin preparation compared to a patient receiving the same preparation for conventional prophylaxis. The foregoing notwithstanding, it is believed that the aaT-XTEN of the present invention permit less frequent dosing, as described above, compared to an aaT not linked to the XTEN.

In one embodiment, the present invention provides aaT-XTEN fusion proteins that exhibits an increase in AUC of at least about 50%, or at least about 60%, or at least about 70%, or at least about 80%, or at least about 90%, or at least about a 100%, or at least about 150%, or at least about 200%, or at least about 300%, or at least about 500%, or at least about 1000%, or at least about a 2000% compared to the corresponding aaT not linked to the XTEN and administered to a subject at a comparable dose. The pharmacokinetic parameters of an aaT-XTEN can be determined by standard methods involving dosing, the taking of blood samples at times intervals, and the assaying of the protein using ELISA, HPLC, radioassay, or other methods known in the art or as described herein, followed by standard calculations of the data to derive the half-life and other PK parameters.

The enhanced PK parameters allow for reduced dosing of the aaT-XTEN compositions, compared to aaT not linked to the XTEN, particularly for those subjects receiving doses for routine prophylaxis. In one embodiment, a smaller moles-equivalent amount of about two-fold less, or about three-fold less, or about four-fold less, or about five-fold less, or about six-fold less, or about eight-fold less, or about 10-fold less or greater of the fusion protein is administered in comparison to the corresponding aaT not linked to the XTEN under a dose regimen needed to maintain a comparable area under the curve as the corresponding amount of the aaT not linked to the XTEN. In another embodiment, a smaller amount of moles of about two-fold less, or about three-fold less, or about four-fold less, or about five-fold less, or about six-fold less, or about eight-fold less, or about 10-fold less or greater of the fusion protein is administered in comparison to the corresponding aaT not linked to the XTEN under a dose regimen needed to maintain a blood concentration above at least 8 µM, or at least 9 µM, or at least 10 µM for at least 48 h compared to the corresponding amount of the aaT not linked to the XTEN. In another embodiment, the aaT-XTEN fusion protein requires less frequent administration for routine prophylaxis of a subject with aaT-deficiency, wherein the dose is administered about every four days, about every seven days, about every 10 days, about every 14 days, about every 21 days, or about monthly of the fusion protein administered to a subject, and the fusion protein achieves a comparable area under the curve as the corresponding aaT not linked to the XTEN. In yet other embodiments, an accumulatively smaller amount of moles of about 5%, or about 10%, or about 20%, or about 40%, or about 50%, or about 60%, or about 70%, or about 80%, or about 90% less of the fusion protein is administered to a subject in comparison to the corresponding amount of the aaT not linked to the XTEN under a dose regimen needed to maintain anti-protease activity, yet the fusion protein achieves at least a comparable area under the curve as the corresponding aaT not linked to the XTEN. The accumulative smaller amount is measure for a period of at least about one week, or about 14 days, or about 21 days, or about one month.

(b) Pharmacology and Pharmaceutical Properties of aaT-XTEN

The present invention provides aaT-XTEN compositions comprising aaT covalently linked to the XTEN that can have enhanced properties compared to aaT not linked to XTEN, as well as methods to enhance the therapeutic and/or biologic activity or effect of the respective two aaT components of the compositions. In addition, the invention provides aaT-XTEN compositions with enhanced properties compared to those art-known fusion proteins of alpha 1-antitrypsin containing albumin, immunoglobulin polypeptide partners, polypeptides of shorter length and/or polypeptide partners with repetitive sequences. In addition, aaT-XTEN fusion proteins provide significant advantages over chemical conjugates, such as pegylated constructs of aaT, notably the fact that recombinant aaT-XTEN fusion proteins can be made in host cell expression systems, which can reduce time and cost at both the research and development and manufacturing stages of a product, as well as result in a more homogeneous, defined product with less toxicity for both the product and metabolites of the aaT-XTEN compared to pegylated conjugates.

As therapeutic agents, the aaT-XTEN possesses a number of advantages over therapeutics not comprising XTEN, including one or more of the following non-limiting enhanced properties: increased solubility, increased thermal stability, reduced immunogenicity, increased apparent molecular weight, reduced renal clearance, reduced proteolysis, reduced metabolism, enhanced therapeutic efficiency, a lower effective therapeutic dose, increased bioavailability, increased time between dosages capable of maintaining a subject without loss of pulmonary capacity or lung function, the ability to administer the aaT-XTEN composition intravenously, subcutaneously, intramuscularly or via pulmonary administration, a "tailored" rate of absorption when administered intravenously, subcutaneously, intramuscularly or via pulmonary administration, enhanced lyophilization stability, enhanced serum/plasma stability, increased terminal half-life, increased solubility in blood stream, decreased binding by neutralizing antibodies, decreased active clearance, reduced side effects, retention of substrate binding affinity, stability to degradation, stability to freeze-thaw, stability to proteases, stability to ubiquitination, ease of administration, compatibility with other pharmaceutical excipients or carriers, persistence in the subject, increased stability in storage (e.g., increased shelf-life), reduced toxicity in an organism or environment and the like. The net effect of the enhanced properties is that the use of an aaT-XTEN composition can result in enhanced therapeutic and/or biologic effect compared to an aaT not linked to the XTEN, result in economic benefits associated with less frequent dosing, or result in improved patient compliance when administered to a subject with a alpha 1-antitrypsin-related disease, disorder or condition.

In one embodiment, XTEN as a fusion partner increases the solubility of the aaT payload. Accordingly, where enhancement of the pharmaceutical or physicochemical properties of the aaT is desirable, such as the degree of aqueous solubility or stability, the length and/or the motif family composition of the XTEN sequences incorporated into the fusion protein may each be selected to confer a different degree of solubility and/or stability on the respective fusion proteins such that the overall pharmaceutical properties of the aaT-XTEN composition are enhanced. The aaT-XTEN fusion proteins can be constructed and assayed, using methods described herein, to confirm the physicochemical properties and the XTEN adjusted, as needed, to result in the desired properties. In one embodiment, the aaT-XTEN has an aqueous solubility that is at least about 25% greater compared to an aaT not linked to the fusion protein, or at least about 30%, or at least about 40%, or at least about 50%, or at least about 75%, or at least about 100%, or at least about 200%, or at least about 300%, or at least about 400%, or at least about 500%, or at least about 1000% greater than the corresponding aaT not linked to the fusion protein.

The invention provides methods to produce and recover expressed aaT-XTEN from a host cell with enhanced solubility and ease of recovery compared to aaT not linked to the XTEN. In one embodiment, the method includes the steps of transforming a eukaryotic host cell with a polynucleotide encoding an aaT-XTEN with one or more XTEN components of cumulative sequence length greater than about 100, or greater than about 200, or greater than about 400, or greater than about 800 amino acid residues, expressing the aaT-XTEN fusion protein in the host cell, and recovering the expressed fusion protein in soluble form. In the foregoing embodiment, the XTEN of the aaT-XTEN fusion proteins can have at least about 80% sequence identity, or about 90%, or about 91%, or about 92%, or about 93%, or about 94%, or about 95%, or about 96%, or about 97%, or about 98%, or about 99%, to about 100% sequence identity compared to one or more XTEN selected from Table 4, and the aaT can have at least about 80% sequence identity, or about 90%, or about 91%, or about 92%, or about 93%, or about 94%, or about 95%, or about 96%, or about 97%, or about 98%, or about 99%, or 100% sequence identity compared to an aaT selected from Table 1 and the aaT-XTEN components can be in an N- to C-terminus configuration selected from any one of formulae I-V.

The invention provides methods to produce the aaT-XTEN compositions that can maintain the aaT component at therapeutic levels in a subject in need thereof for at least a two-fold, or at least a three-fold, or at least a four-fold, or at least a five-fold greater period of time compared to comparable dosages of the corresponding aaT not linked to the XTEN. In one embodiment of the method, the subject is receiving routine prophylaxis to prevent loss of pulmonary function; e.g., reductions in FEV1 or FVC. In another embodiment of the method, the subject is receiving treatment for emphysema. It will be understood in the art that a "comparable dosage" of aaT-XTEN fusion protein would represent a greater weight of agent but would have the same approximate moles of aaT in the dose of the fusion protein and/or would have the same approximate molar concentration relative to the dose of aaT not linked to the XTEN. The method to produce the compositions that can maintain the aaT component at therapeutic levels includes the steps of selecting the XTEN appropriate for conjugation to an aaT to provide the desired pharmacokinetic properties in view of a given dose and dose regimen, creating a gene construct that encodes the aaT-XTEN, transforming an appropriate host cell with an expression vector comprising the encoding gene, expressing and recovering the aaT-XTEN, administration of the aaT-XTEN to a subject in need thereof followed by assays to verify the pharmacokinetic properties, the activity of the aaT-XTEN fusion protein (e.g., the ability to maintain hemostasis), and the safety of the administered composition. By the methods, aaT-XTEN provided herein can result in increased efficacy of the administered composition by maintaining the circulating concentrations of the aaT at therapeutic levels for an enhanced period of time.

The characteristics of aaT-XTEN compositions of the invention, including functional characteristics or biologic and pharmacologic activity and parameters that result, can be determined by any suitable screening assay known in the art for measuring the desired characteristic. The invention provides methods to assay the aaT-XTEN fusion proteins of differing composition or configuration in order to provide aaT-XTEN with the desired degree of biologic and/or therapeutic activity, as well as safety profile. Specific in vitro, in vivo and ex vivo biological assays are used to assess the activity of each configured aaT-XTEN and/or aaT component to be incorporated into aaT-XTEN, including but not limited to the assays of the Examples, assays of Table 39, determination of human leukocyte elastase (HLE) inhibitory capacity (Cantan, A, et al. Am, J. Resp. Cell Mol. Biol. (2002) 27:659-665), binding affinity and association rate constant for neutrophil elastase, competitive binding assays, such as Biacore assays with chip-bound receptors or binding proteins or ELISA assays, or lung function tests to measure total lung capacity, forced vital capacity (FVC), or forced expiratory volume (FEV) for COPD or emphysema, as well as clinical endpoints such as organ failure and/or survival, among others known in the art. The foregoing assays can also be used to assess aaT sequence variants (assayed as single components or as aaT-XTEN fusion proteins) and can be compared to the native human aaT to determine whether they have the same degree of biologic activity as the native aaT, or some fraction thereof such that they are suitable for inclusion in aaT-XTEN; e.g., at least about 40%, or at least about 50%, or at least about 60%, or at least about 70%, or at least about 80%, or at least about 90% of the activity compared to the native aaT.

Dose optimization is important for all drugs. A therapeutically effective dose or amount of the aaT-XTEN varies according to factors such as the disease state, age, sex, and weight of the individual, and the ability of the administered fusion protein to elicit a desired response in the individual. For example, a standardized single dose of aaT for all patients presenting with diverse pulmonary conditions or abnormal clinical parameters (e.g., neutralizing antibodies) may not always be effective. A consideration of these factors is well within the purview of the ordinarily skilled clinician for the purpose of determining the therapeutically or pharmacologically effective amount of the aaT-XTEN and the appropriated dosing schedule, versus that amount that would result in insufficient potency such that clinical improvement is not achieved.

The methods of the invention includes administration of consecutive doses of a therapeutically effective amount of the aaT-XTEN for a period of time sufficient to achieve and/or maintain the desired parameter or clinical effect, and such consecutive doses of a therapeutically effective amount establishes the therapeutically effective dose regimen for the aaT-XTEN, i.e., the schedule for consecutively administered doses of the fusion protein composition, wherein the doses are given in amounts to result in a sustained beneficial effect on any clinical sign or symptom, aspect, measured parameter or characteristic of a alpha 1-antitrypsin-related disease state or condition, including, but not limited to, those described herein. A prophylactically effective amount refers to an amount of aaT-XTEN required for the period of time necessary to prevent a physiologic or clinical result or event; e.g., loss of total lung capacity, reduced forced vital capacity (FVC; e.g., a greater than 20% reduction in predicted lung capacity), reduced forced expiratory volume (FEV; e.g., an FEV1 value less than 50% predicted value), as well as clinical endpoints such as organ failure and/or survival, or maintaining blood concentrations of aaT above a threshold level, e.g., 10 µM. In the methods of treatment, the dosage amount of the aaT-XTEN that is administered to a subject ranges from about 5 to 500 mg/kg/dose, or from about 10 to 300 mg/kg/dose, or from about 20 to about 100 mg/kg/dose, or from about 40 to about 60 mg/kg/dose for a subject. A suitable dosage may also depend on other factors that may influence the response to the drug; e.g., subjects with a FEV1 of less than 25% predicted value generally requiring higher doses at more frequent intervals compared to prophylaxis.

In some embodiments, the method comprises administering a therapeutically-effective amount of a pharmaceutical composition comprising an aaT-XTEN fusion protein composition comprising aaT linked to one or more XTEN sequences and at least one pharmaceutically acceptable carrier to a subject in need thereof that results in a greater improvement in at least one of the disclosed parameters or physiologic conditions, or results in a more favorable clinical outcome mediated by the aaT component of the aaT-XTEN compared to the effect on the parameter, condition or clinical outcome mediated by administration of a pharmaceutical composition comprising an aaT not linked to XTEN and administered at a comparable dose. In one embodiment of the foregoing, the improvement is achieved by administration of the aaT-XTEN pharmaceutical composition at a therapeutically effective dose. In another embodiment of the foregoing, the improvement is achieved by administration of multiple consecutive doses of the aaT-XTEN pharmaceutical composition using a therapeutically effective dose regimen (as defined herein) for the length of the dosing period.

In many cases, the therapeutic levels for aaT in subjects of different ages or degree of disease have been established and are available in published literature or are stated on the drug label for approved products containing the aaT. In other cases, the therapeutic levels can be established for new compositions, including those aaT-XTEN fusion proteins of the disclosure. The methods for establishing the therapeutic levels and dosing schedules for a given composition are known to those of skill in the art (see, e.g., Goodman & Gilman's The Pharmacological Basis of Therapeutics, 11$^{th}$ Edition, McGraw-Hill (2005)). For example, by using dose-escalation studies in subjects with the target disease or disorder to determine efficacy or a desirable pharmacologic effect, appearance of adverse events, and determination of circulating blood levels, the therapeutic blood levels for a given subject or population of subjects can be determined for a given drug or biologic. The dose escalation studies can evaluate the activity of an aaT-XTEN through metabolic studies in a subject or group of subjects that monitor physiological or biochemical parameters, as known in the art or as described herein for one or more parameters associated with the alpha 1-antitrypsin-related disease or disorder, or clinical parameters associated with a beneficial outcome for the particular indication, together with observations and/or measured parameters to determine the no effect dose, adverse events, minimum effective dose and the like, together with measurement of pharmacokinetic parameters that establish the determined or derived circulating blood levels. The results can then be correlated with the dose administered and the blood concentrations of the therapeutic that are coincident with the foregoing determined parameters or effect levels. By these methods, a range of doses and blood concentrations can be correlated to the minimum effective dose as well as the maximum dose and blood concentration at which a desired effect occurs and the period for which it can be maintained, thereby establishing the therapeutic blood levels and dosing schedule for the composition. Thus, by the foregoing methods, a $C_{min}$ blood level is established, below which the aaT-XTEN fusion protein would not have the desired pharmacologic effect and a $C_{max}$ blood level, above which side effects may occur.

One of skill in the art can, by the means disclosed herein or by other methods known in the art, confirm that the administered aaT-XTEN remains at therapeutic blood levels to maintain anti-proteinase activity for the desired interval or requires adjustment in dose or length or sequence of XTEN. Further, the determination of the appropriate dose and dose frequency to keep the aaT-XTEN within the therapeutic window establishes the therapeutically effective dose regimen; the schedule for administration of multiple consecutive doses using a therapeutically effective dose of the fusion protein to a subject in need thereof resulting in consecutive $C_{max}$ peaks and/or $C_{min}$ troughs that remain above therapeutically-effective concentrations and result in an improvement in at least one measured parameter relevant for the target disease, disorder or condition. In one embodiment, the aaT-XTEN administered at an appropriate dose to a subject results in blood concentrations of the aaT-XTEN fusion protein that remains above the minimum effective concentration to maintain a given protease neutralization capacity (as determined by the assays of the Examples or Table 39) for a period at least about two-fold longer compared to the corresponding aaT not linked to XTEN and administered at a comparable dose; alternatively at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer, alternatively at least about ten-fold longer, or at least about twenty-fold longer or greater compared to the corresponding aaT not linked to XTEN and administered at a comparable dose. As used herein, an "appropriate dose" means a dose of a drug or biologic that, when administered to a subject, would result in a desirable therapeutic or pharmacologic effect and/or a blood concentration within the therapeutic window. For example, serum or plasma levels of alpha 1-antitrypsion can be measured by nephelometry or by immunoelectrophoresis. Phenotypic identification of aaT or aaT variants can be accomplished by a number of methods including isoelectric focusing (IEF) (Jeppsson et al., *Proc. Natl. Acad. Sci. USA*, 81:5690-93, 1994), or by DNA analysis (Kidd et al., *Nature*, 304:230-34, 1983; Braun et al., *Eur. J. Clin. Chem. Clin. Biochem.*, 34:761-64, 1996). In one embodiment, the aaT-XTEN administered using a therapeutically effective amount to a subject results in blood concentrations of the aaT-XTEN fusion protein that remains above at least 8 μM, or at least about 9 μM, or at least about 10 μM, or at least about 11 μM, or at least about 12 μM, or at least about 13 μM, or at least about 14 μM, or at least about 16 μM, or at least about 18 μM, or at least about 20 μM, or at least about 25 μM for at least about 24 hours, or at least about 48 hours, or at least about 72 hours, or at least about 96 hours, or at least about 120 hours, or at least about 144 hours. In another embodiment, the aaT-XTEN administered at an appropriate dose to a subject results in blood concentrations of the aaT-XTEN fusion protein that remains above at least 8 μM, or at least about 9 μM, or at least about 10 μM, or at least about 11 μM, or at least about 12 μM, or at least about 13 μM, or at least about 14 μM, or at least about 16 μM, or at least about 18 μM, or at least about 20 μM, or at least about 25 μM for at least 72 hours. In another embodiment, the aaT-XTEN administered at an appropriate dose to a subject results in blood concentrations of the aaT-XTEN fusion protein that remains above at least 8 μM, or at least about 9 μM, or at least about 10 μM, or at least about 11 μM, or at least about 12 μM, or at least about 13 μM, or at least about 14 μM, or at least about 16 μM, or at least about 18 μM, or at least about 20 μM, or at least about 25 μM for at least 96 hours. In another embodiment, the aaT-XTEN administered at an appropriate dose to a subject results in blood concentrations of the aaT-XTEN fusion protein that remains above at least 8 µM, or at least about 9 µM, or at least about 10 µM, or at least about 11 µM, or at least about 12 µM, or at least about 13 µM, or at least about 14 µM, or at least about 16 µM, or at least about 18 µM, or at least about 20 µM, or at least about 25 µM for at least 7 days. In another embodiment, the aaT-XTEN administered at an appropriate dose to a subject results in blood concentrations of the aaT-XTEN fusion protein that remains above at least 8 µM, or at least about 9 µM, or at least about 10 µM, or at least about 11 µM, or at least about 12 µM, or at least about 13 µM, or at least about 14 µM, or at least about 16 µM, or at least about 18 µM, or at least about 20 µM, or at least about 25 µM for at least 10 days. In another embodiment, the aaT-XTEN administered at an appropriate dose to a subject results in blood concentrations of the aaT-XTEN fusion protein that remains above at least 8 µM, or at least about 9 µM, or at least about 10 µM, or at least about 11 µM, or at least about 12 µM, or at least about 13 µM, or at least about 14 µM, or at least about 16 µM, or at least about 18 µM, or at least about 20 µM, or at least about 25 µM for at least 14 days.

In one embodiment, administration of at least three doses of an aaT-XTEN using a therapeutically effective dose regimen results in a gain in time of at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer between at least two consecutive $C_{max}$ peaks and/or $C_{min}$ troughs for blood levels of the fusion protein compared to the corresponding biologically active protein of the fusion protein not linked to the XTEN and administered at a comparable dose regimen to a subject. In another embodiment, the aaT-XTEN administered at a therapeutically effective dose regimen results in a comparable improvement in one, or two, or three or more measured parameters using less frequent dosing or a lower total dosage in moles of the fusion protein of the pharmaceutical composition compared to the corresponding biologically active protein component(s) not linked to the XTEN and administered to a subject using a therapeutically effective dose regimen for the aaT. The measured parameters include any of the clinical, biochemical, or physiological parameters disclosed herein, or others known in the art for assessing subjects with alpha 1-antitrypsin-related disorders. Non-limiting examples of parameters or physiologic effects that can be assayed to assess the activity of the aaT-XTEN fusion proteins include assays of Table 39 or lung function tests to measure total lung capacity, forced vital capacity (FVC), or forced expiratory volume (FEV) for COPD or emphysema, as well as clinical endpoints such as organ failure and/or survival, among others known in the art for alpha 1-antitrypsin-related disorders.

In some embodiments, the activity of the aaT component is manifested by the intact aaT-XTEN fusion protein, while in other cases the activity of the aaT component is primarily manifested upon cleavage and release of the aaT from the fusion protein by action of a protease that acts on a cleavage sequence incorporated into the aaT-XTEN fusion protein. In the foregoing, the aaT-XTEN is designed to reduce the binding affinity of the aaT component for the protease target when linked to the XTEN but have restored or increased affinity when released from XTEN through the cleavage of cleavage sequence(s) incorporated into the aaT-XTEN sequence. In one embodiment of the foregoing, the invention provides an isolated fusion protein comprising an aaT linked to at least a first XTEN by a cleavage sequence, wherein the fusion protein is substantially inactive prior to cleavage and wherein the aaT released from the fusion protein by proteolytic cleavage at the cleavage sequence has biological activity that is at least about 40%, at least about 50%, at least about 60%, or at least about 70%, or at least about 80%, or at least about 90%, or at least about 95% as active compared to native aaT not linked to the XTEN.

In one aspect, the invention provides aaT-XTEN compositions designed to reduce active clearance of the fusion protein, thereby increasing the terminal half-life of aaT-XTEN administered to a subject, while still retaining biological activity. Without being bound by any particular theory, it is believed that the aaT-XTEN of the present invention have comparatively higher and/or sustained activity achieved by reduced active clearance of the molecule by the addition of unstructured XTEN to the aaT. Uptake, elimination, and inactivation of aaT can occur in the circulatory system as well as in the extravascular space.

In one embodiment, the invention provides aaT-XTEN that enhance the pharmacokinetics of the fusion protein by linking one or more XTEN to the aaT component of the fusion protein, wherein the fusion protein has an increase in apparent molecular weight factor of at least about two-fold, or at least about three-fold, or at least about four-fold, or at least about five-fold, or at least about six-fold, or at least about seven-fold, or at least about eight-fold, or at least about ten-fold, or at least about twelve-fold, or at least about fifteen-fold, and wherein the terminal half-life of the aaT-XTEN when administered to a subject is increased at least about two-fold, or at least about four-fold, or at least about eight-fold, or at least about 10-fold or more compared to the corresponding aaT not linked to the XTEN. In the foregoing embodiment, wherein at least two XTEN molecules are incorporated into the aaT-XTEN, the XTEN can be identical or they can be of a different sequence composition (and net charge) or length. The XTEN can have at least about 80% sequence identity, or at least about 90%, or at least about 95%, or at least about 98%, or at least about 99% sequence identity compared to a sequence selected from Table 4. Not to be bound by a particular theory, the XTEN of the aaT-XTEN compositions with the higher net charge are expected, as described above, to have less non-specific interactions with various negatively-charged surfaces such as blood vessels, tissues, or various receptors, which would further contribute to reduced active clearance. Conversely, the XTEN of the aaT-XTEN compositions with a low (or no) net charge are expected to have a higher degree of interaction with surfaces that potentiate the activity of the associated aaT, given the known association of inflammatory cells in the alveoli of lungs during an inflammatory response. Thus, the invention provides aaT-XTEN in which the degree of potency, bioavailability, and half-life of the fusion protein can be tailored by the selection and placement of the type and length of the XTEN in the aaT-XTEN compositions. Accordingly, the invention contemplates compositions in which an aaT from Table 1 and XTEN from Table 4 are substituted for the respective components of the foregoing embodiments, and are produced, for example, in a configuration selected from any one of formulae I-V such that the construct has reduced clearance. The invention further takes advantage of the fact that certain ligands with reduced binding to a clearance receptor, either as a result of a decreased on-rate or an increased off-rate, may be effected by the obstruction of either the N- or C-terminus and using that terminus as the linkage to another polypeptide of the composition, whether another molecule of an aaT, an XTEN, or a spacer sequence results in the reduced binding. The choice of the particular configuration of the aaT-XTEN fusion protein can be tested by methods disclosed herein to confirm those configurations that reduce the degree of binding to a clearance receptor such that a reduced rate of active clearance is achieved.

VI). Uses of the aaT-XTEN Compositions

In another aspect, the invention provides a method for achieving a beneficial effect in an alpha 1-antitrypsin-related disease, disorder or condition mediated by deficiency of aaT. As used herein, "alpha 1-antitrypsin-related diseases, disorders or conditions" is intended to include, but is not limited to genetic alpha 1-antitrypsin deficiency, emphysema, chronic obstructive pulmonary disease (COPD), bronchiectasis, parenchymatic and fibrotic lung diseases or disorders, cystic fibrosis, interstitial pulmonary fibrosis, lung sarcoidosis, liver cirrhosis, liver failure, tuberculosis and lung diseases and disorders secondary to HIV.

The present invention provides methods for treating a subject, such as a human, with a alpha 1-antitrypsin-related disease, disorder or condition in order to achieve a beneficial effect, addressing disadvantages and/or limitations of other methods of treatment using aaT preparations that are plasma-derived or that have a relatively short terminal half-life, require repeated administrations, or have unfavorable pharmacoeconomics. The fact that aaT proteins, particularly nonglycosylated aaT proteins, have a short half-life necessitates frequent dosing in order to achieve clinical benefit, which results in difficulties in the management of such patients.

In one embodiment, the method of treatment comprises administering a therapeutically- or prophylactically-effective amount of an aaT-XTEN composition to a subject suffering from or at risk of developing an alpha 1-antitrypsin-related disease, disorder or condition, wherein the administration results in the improvement of one or more biochemical, physiological or clinical parameters associated with the disease, disorder or condition. In the foregoing method, the administered aaT-XTEN comprises an aaT with at least about 80%, or at least about 90%, or at least about 95%, or at least about 97%, or at least about 99% sequence identity to a alpha 1-antitrypsin of Table 1. In another embodiment of the foregoing method, the administered aaT-XTEN has a sequence with at least about 80%, or at least about 90%, or at least about 95%, or at least about 97%, or at least about 99% sequence identity to a sequence of Table 40 or Table 41. In one embodiment, the method of treatment comprises administering a therapeutically-effective amount of an aaT-XTEN composition to a subject suffering from aaT deficiency wherein the administration results in the improvement of one or more biochemical, physiological or clinical parameters associated with the disease, disorder or condition for a period at least two-fold longer, or at least four-fold longer, or at least five-fold longer, or at least six-fold longer compared to an aaT not linked to the XTEN and administered at a comparable dose. In another embodiment, the method of treatment comprises administering a therapeutically-effective amount of an aaT-XTEN composition to a subject suffering from aaT deficiency wherein the administration results in preventing onset of a clinically relevant parameter or symptom or dropping below a clinically-relevant threshold value (such as disclosed herein, e.g., FEV1 of 50% predicted value) for a duration at least two-fold, or at least three-fold, or at least four-fold longer compared to an aaT not linked to the XTEN.

In some embodiments, administration of the aaT-XTEN to a subject results in an improvement in one or more of the biochemical, physiologic, or clinical parameters that is of greater magnitude than that of the corresponding aaT component not linked to the XTEN, determined using the same assay or based on a measured clinical parameter. In one embodiment of the foregoing, the administration of a therapeutically effective amount of an aaT-XTEN composition to a subject in need thereof results in a greater capacity of the blood to neutralize a given concentration of a trypsin protease in an in vitro assay of at least about 5%, or about 10%, or about 20%, or about 30%, or about 40%, or about 50%, or about 60%, or about 70%, or more in the subject at 2-7 days after administration compared to the neutralization capacity in a subject after administration of a comparable amount of the corresponding aaT not linked to the XTEN. In another embodiment, the administration of an aaT-XTEN to a subject in need thereof using a therapeutically effective amount results in maintenance of functional alpha 1-antitrypsin activity within 10% of normal in the subject for a period of time that is at least two-fold, or at least about three-fold, or at least about four-fold longer compared to that of an aaT not linked to the XTEN and administered to a subject using a comparable dose.

In some embodiments of the method of treatment, (i) a smaller amount of moles of about two-fold less, or about three-fold less, or about four-fold less, or about five-fold less, or about six-fold less, or about eight-fold less, or about 10-fold less of the aaT-XTEN fusion protein is administered to a subject in need thereof in comparison to the corresponding aaT not linked to the XTEN under an otherwise same dose regimen, and the fusion protein achieves a comparable area under the curve and/or a comparable therapeutic effect as the corresponding aaT not linked to the XTEN; (ii) the aaT-XTEN fusion protein is administered less frequently (e.g., every three days, about every seven days, about every 10 days, about every 14 days, about every 21 days, or about monthly) in comparison to the corresponding aaT not linked to the XTEN under an otherwise same dose amount, and the fusion protein achieves a comparable area under the curve and/or a comparable therapeutic effect as the corresponding aaT not linked to the XTEN; or (iii) an accumulative smaller amount of moles of at least about 20%, or about 30%, or about 40%, or about 50%, or about 60%, or about 70%, or about 80%, or about 90% less of the fusion protein is administered in comparison to the corresponding aaT not linked to the XTEN under an otherwise same dose regimen and the aaT-XTEN fusion protein achieves a comparable area under the curve and/or a comparable therapeutic effect as the corresponding aaT not linked to the XTEN. The accumulative smaller amount is measured for a period of at least about one week, or about 14 days, or about 21 days, or about one month. In the foregoing embodiments of the method of treatment, the therapeutic effect can be determined by any of the measured parameters described herein, including but not limited to blood concentrations of aaT, assays of Table 39, or lung function tests to measure total lung capacity, forced vital capacity (FVC), or forced expiratory volume (FEV1) for COPD or emphysema, as well as clinical endpoints such as organ failure and/or survival, among others known in the art for alpha 1-antitrypsin-related disorders.

The invention further contemplates that the aaT-XTEN used in accordance with the methods provided herein can be administered in conjunction with other treatment methods and compositions (e.g., anti-inflammatory agents such as steroids or NSAIDS) useful for treating aaT-related diseases, disorders, and conditions, or conditions for which aaT is adjunctive therapy.

In another aspect, the invention provides a method of preparing a medicament for treatment of a alpha 1-antitrypsin-related disease, disorder or condition, comprising combining an alpha 1-antitrypsin sequence selected from Table 1 with one or more XTEN to result in an aaT-XTEN fusion protein, wherein the aaT-XTEN retains at least a portion of the activity of the native aaT, and further combining the aaT-XTEN with at least one pharmaceutically acceptable carrier. In one embodiment of the method, the alpha 1-antitrypsin has a sequence with at least about 80%, or at least about 90%, or at least about 95%, or at least about 97%, or at least about 99% sequence identity compared to a sequence selected from Table 1 and the one or more XTEN has a sequence with at least about 80%, or at least about 90%, or at least about 95%, or at least about 97%, or at least about 99% sequence identity compared to a sequence selected from Table 4, or a fragment thereof. In another embodiment of the method, the aaT-XTEN has a sequence with at least about 80%, or at least about 90%, or at least about 95%, or at least about 97%, or at least about 99% sequence identity compared to a sequence selected from any one of Table 40 or 41.

In another aspect, the invention provides a method of designing the aaT-XTEN compositions to achieve desired pharmacokinetic, pharmacologic or pharmaceutical properties. In general, the steps in the design and production of the fusion proteins and the inventive compositions, as illustrated in FIGS. 10-13, include: (1) selecting an aaT (e.g., native proteins, sequences of Table 1, analogs or derivatives with activity) to treat the particular disease, disorder or condition; (2) selecting the XTEN that will confer the desired PK and physicochemical characteristics on the resulting aaT-XTEN (e.g., the administration of the aaT-XTEN composition to a subject results in the fusion protein being maintained within the therapeutic window for a greater period compared to aaT not linked to the XTEN); (3) establishing a desired N- to C-terminus configuration of the aaT-XTEN to achieve the desired efficacy or PK parameters; (4) establishing the design of the expression vector encoding the configured aaT-XTEN; (5) transforming a suitable host with the expression vector; and (6) expressing and recovering of the resultant fusion protein. For those aaT-XTEN for which an increase in half-life or an increased period of time spent above the minimum effective concentration is desired, the XTEN chosen for incorporation generally has at least about 288, or about 432, or about 576, or about 864, or about 875, or about 912, or about 923 amino acid residues where a single XTEN is to be incorporated into the aaT-XTEN. In another embodiment, the aaT-XTEN comprises a first XTEN of the foregoing lengths, and at least a second XTEN of about 36, or about 72, or about 144, or about 288, or about 576, or about 864, or about 875, or about 912, or about 923, or about 1000 or more amino acid residues.

In another aspect, the invention provides methods of making aaT-XTEN compositions to improve ease of manufacture, result in increased stability, increased water solubility, and/or ease of formulation, as compared to the native aaT. In one embodiment, the invention includes a method of increasing the water solubility of an aaT comprising the step of linking the aaT to one or more XTEN such that a higher concentration in soluble form of the resulting aaT-XTEN can be achieved, under physiologic conditions, compared to the aaT in an un-fused state. Factors that contribute to the property of XTEN to confer increased water solubility of aaT when incorporated into a fusion protein include the high solubility of the XTEN fusion partner and the low degree of self-aggregation between molecules of XTEN in solution. In one embodiment of the foregoing, the aaT-XTEN comprises an aaT linked to two XTENs having at least about 36, or about 48, or about 96, or about 144, or about 288 amino acid residues in which the solubility of the fusion protein under physiologic conditions is at least three-fold greater than the corresponding aaT not linked to the XTEN, or alternatively, at least four-fold, or five-fold, or six-fold, or seven-fold, or eight-fold, or nine-fold, or at least 10-fold, or at least 20-fold, or at least 30-fold, or at least 50-fold, or at least 60-fold or greater than aaT not linked to the XTEN. In one embodiment of the foregoing, the aaT has at least about 80%, or about 90%, or about 95% identity to a sequence from Table 1 and the XTEN is a sequence with at least about 80%, or about 90%, or about 95% sequence identity compared to a sequence from Table 4. In some embodiments, the method results in an aaT-XTEN fusion protein wherein the water solubility is at least about 20%, or at least about 30% greater, or at least about 50% greater, or at least about 75% greater, or at least about 90% greater, or at least about 100% greater, or at least about 150% greater, or at least about 200% greater, or at least about 400% greater, or at least about 600% greater, or at least about 800% greater, or at least about 1000% greater, or at least about 2000% greater under physiologic conditions, compared to the un-fused aaT.

In another embodiment, the invention includes a method of increasing the shelf-life of an aaT comprising the step of linking the aaT with one or more XTEN selected such that the shelf-life of the resulting aaT-XTEN is extended compared to the aaT in an un-fused state. As used herein, shelf-life refers to the period of time over which the functional activity of an aaT or aaT-XTEN that is in solution or in some other storage formulation remains stable without undue loss of activity. As used herein, "functional activity" refers to a pharmacologic effect or biological activity, such as the ability to bind a receptor or ligand, or substrate, or an enzymatic activity, or to display one or more known functional activities associated with an aaT, as known in the art. An aaT that degrades or aggregates generally has reduced functional activity or reduced bioavailability compared to one that remains in solution. Factors that contribute to the ability of the method to extend the shelf life of aaTs when incorporated into a fusion protein include increased water solubility, reduced self-aggregation in solution, and increased heat stability of the XTEN fusion partner. In particular, the low tendency of XTEN to aggregate facilitates methods of formulating pharmaceutical preparations containing higher drug concentrations of aaTs, and the heat-stability of XTEN contributes to the property of aaT-XTEN fusion proteins to remain soluble and functionally active for extended periods. In one embodiment, the method results in aaT-XTEN fusion proteins with "prolonged" or "extended" shelf-life that exhibit greater activity relative to a standard that has been subjected to the same storage and handling conditions. The standard may be the un-fused full-length aaT. In one embodiment, the method includes the step of formulating the isolated aaT-XTEN with one or more pharmaceutically acceptable excipients that enhance the ability of the XTEN to retain its unstructured conformation and for the aaT-XTEN to remain soluble in the formulation for a time that is greater than that of the corresponding un-fused aaT. In one embodiment, the method comprises linking an aaT to one or more XTEN selected from Table 4 to create an aaT-XTEN fusion protein results in a solution that retains greater than about 100% of the functional activity, or greater than about 105%, 110%, 120%, 130%, 150% or 200% of the functional activity of a standard when compared at a given time point and when subjected to the same storage and handling conditions as the standard, thereby increasing its shelf-life.

Shelf-life may also be assessed in terms of functional activity remaining after storage, normalized to functional activity when storage began. aaT-XTEN fusion proteins of the invention with prolonged or extended shelf-life as exhibited by prolonged or extended functional activity retain about 50% more functional activity, or about 60%, 70%, 80%, or 90% more of the functional activity of the equivalent aaT not linked to the XTEN when subjected to the same conditions for the same period of time. For example, an aaT-XTEN fusion protein of the invention comprising aaT fused to one or more XTEN sequences selected from Table 4 retains about 80% or more of its original activity in solution for periods of up to 2 weeks, or 4 weeks, or 6 weeks, or 12 weeks or longer under various elevated temperature conditions. In some embodiments, the aaT-XTEN retains at least about 50%, or about 60%, or at least about 70%, or at least about 80%, and most preferably at least about 90% or more of its original activity in solution when heated at 80° C. for 10 min. In other embodiments, the aaT-XTEN retains at least about 50%, preferably at least about 60%, or at least about 70%, or at least about 80%, or alternatively at least about 90% or more of its original activity in solution when heated or maintained at 37° C. for about 7 days. In another embodiment, aaT-XTEN fusion protein retains at least about 80% or more of its functional activity after exposure to a temperature of about 30° C. to about 70° C. over a period of time of about one hour to about 18 hours. In the foregoing embodiments hereinabove described in this paragraph, the retained activity of the aaT-XTEN is at least about two-fold, or at least about three-fold, or at least about four-fold, or at least about five-fold, or at least about six-fold greater at a given time point than that of the corresponding aaT not linked to the XTEN.

VII). The Nucleic Acids Sequences of the Invention

Figure 11:
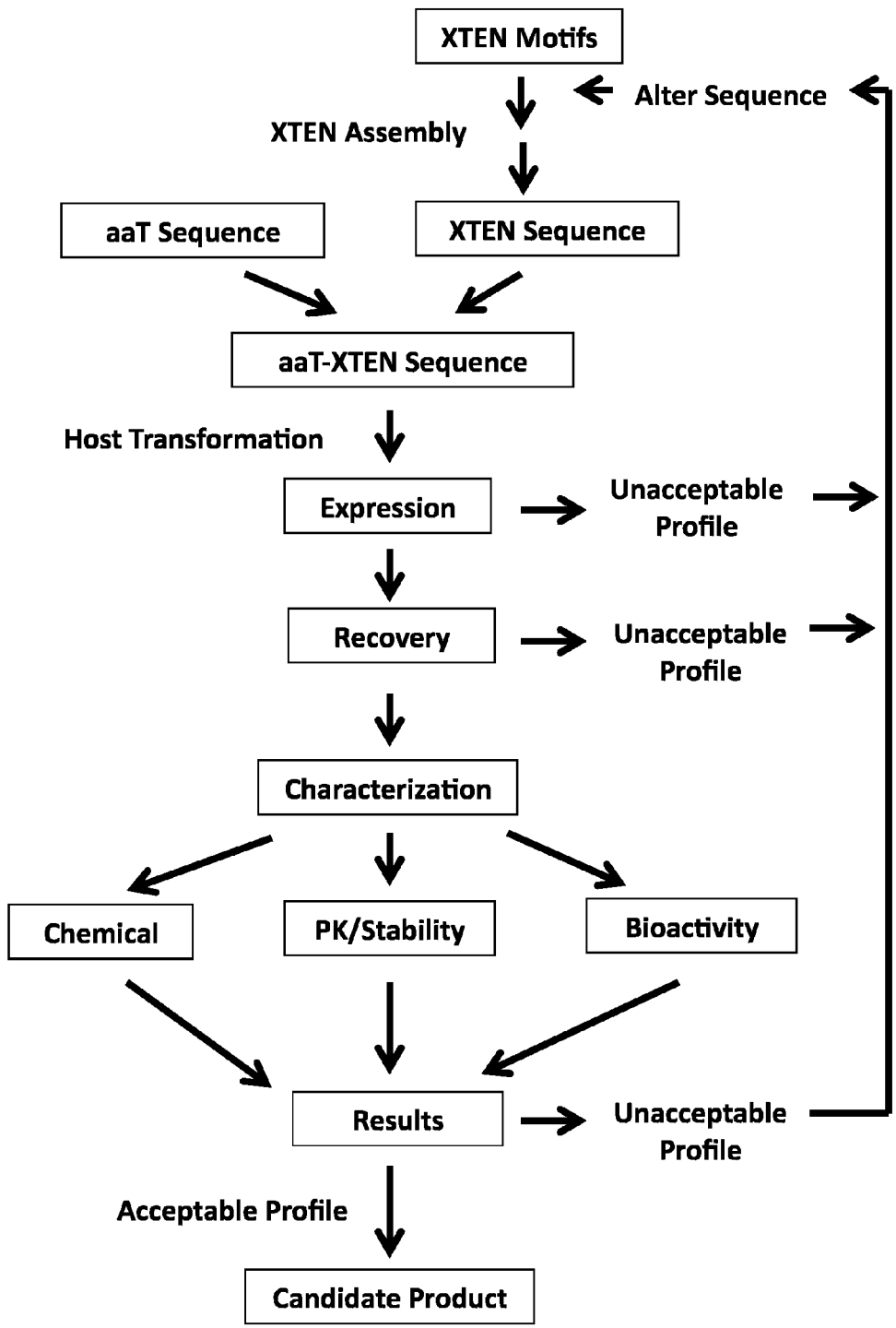
FIG. 11 is a schematic flowchart of representative steps in the assembly of a gene encoding fusion protein comprising an aaT and XTEN, its expression and recovery as a fusion protein, and its evaluation as a candidate aaT-XTEN product.
Figure 12:
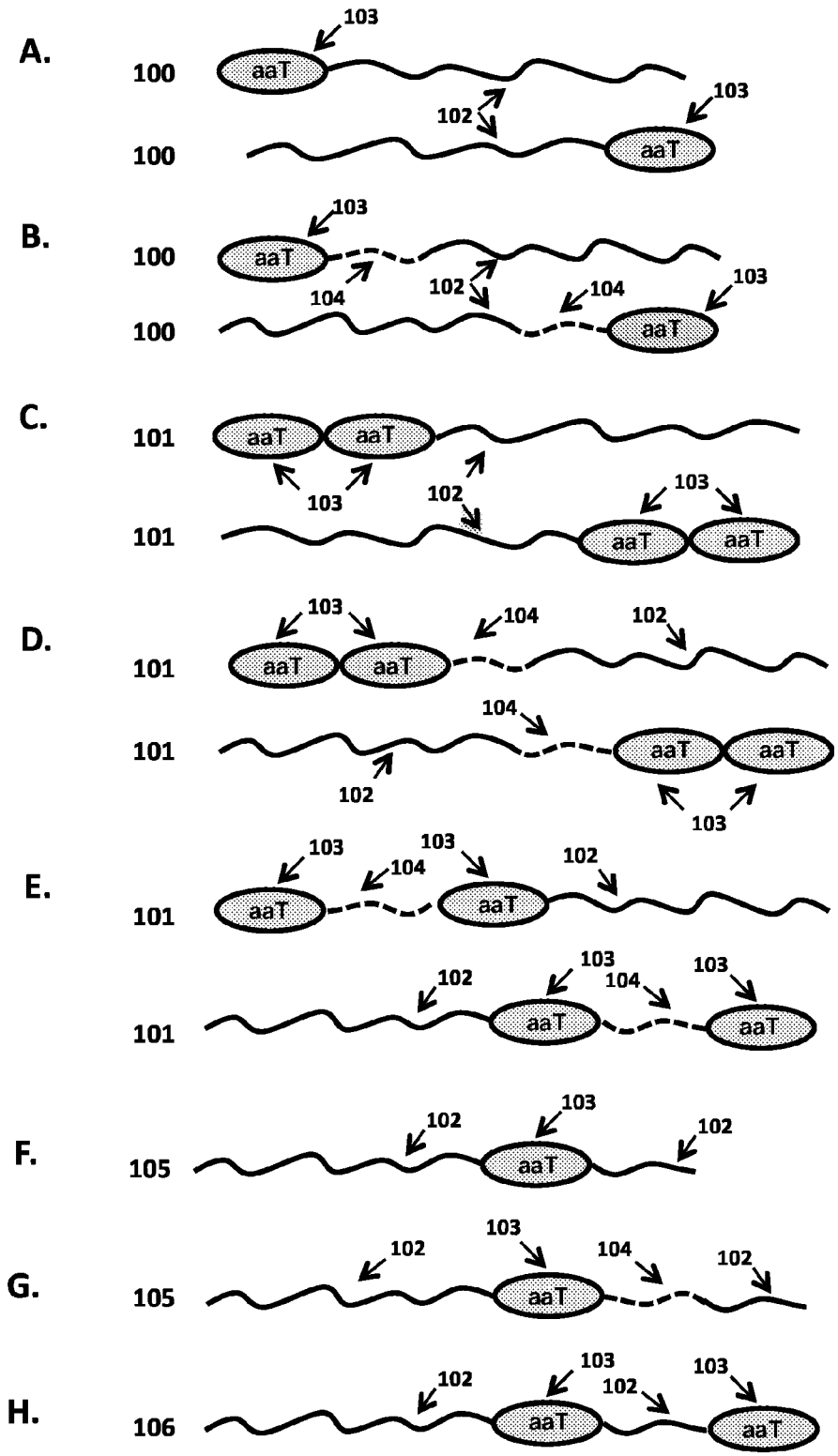
FIG. 12 shows schematic representations of exemplary aaT-XTEN fusion proteins (FIGS. 12A-H), all depicted in an N- to C-terminus orientation.
Figure 13:
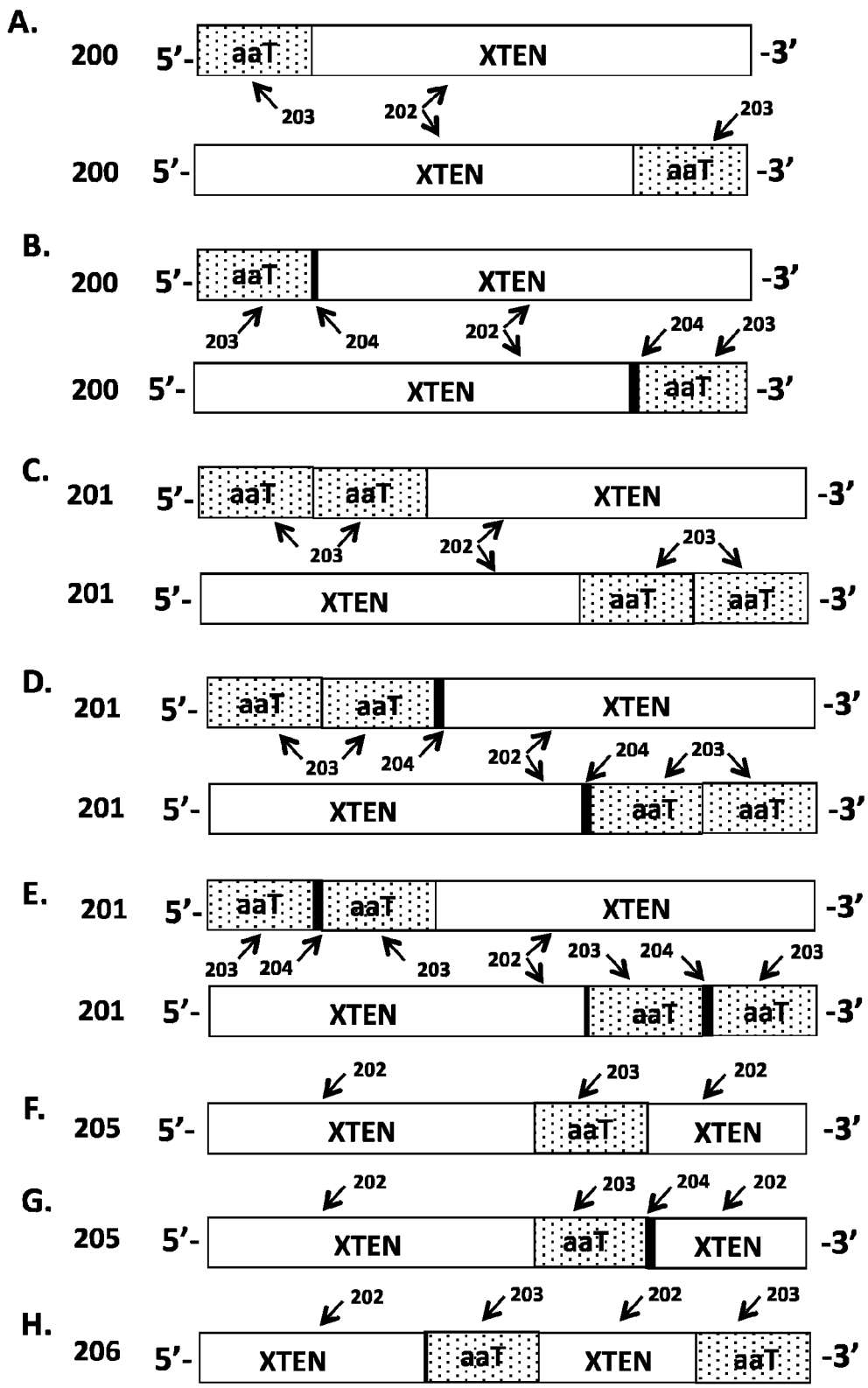
FIG. 13 is a schematic illustration of exemplary polynucleotide constructs (FIGS. 13A-H) of aaT-XTEN genes that encode the corresponding aaT-XTEN polypeptides of FIG. 1; all depicted in a 5' to 3' orientation. In these illustrative examples the genes encode aaT-XTEN fusion proteins with one aaT and XTEN (200); or one aaT, one spacer sequence and one XTEN (200); two aaT and one XTEN (201); or two aaT, a spacer sequence and one XTEN (201); one aaT and two XTEN (205); or two aaT and two XTEN (206). In these depictions, the polynucleotides encode the following components: XTEN (202), aaT (203), and spacer amino acids that can include a cleavage sequence (204), with all sequences linked in frame.

The present invention provides isolated polynucleic acids encoding aaT-XTEN chimeric fusion proteins and sequences complementary to polynucleic acid molecules encoding aaT-XTEN chimeric fusion proteins, including homologous variants thereof. In another aspect, the invention encompasses methods to produce polynucleic acids encoding aaT-XTEN chimeric fusion proteins and sequences complementary to polynucleic acid molecules encoding aaT-XTEN chimeric fusion protein, including homologous variants thereof. In general, and as illustrated in FIGS. 11-13, the methods of producing a polynucleotide sequence coding for an aaT-XTEN fusion protein and expressing the resulting gene product include assembling nucleotides encoding aaT and XTEN, ligating the components in frame, incorporating the encoding gene into an expression vector appropriate for a host cell, transforming the appropriate host cell with the expression vector, and culturing the host cell under conditions causing or permitting the fusion protein to be expressed in the transformed host cell, thereby producing the biologically-active aaT-XTEN polypeptide, which is recovered as an isolated fusion protein by standard protein purification methods known in the art. Standard recombinant techniques in molecular biology are used to make the polynucleotides and expression vectors of the present invention.

In accordance with the invention, nucleic acid sequences that encode aaT-XTEN (or its complement) are used to generate recombinant DNA molecules that direct the expression of aaT-XTEN fusion proteins in appropriate host cells. Several cloning strategies are suitable for performing the present invention, many of which is used to generate a construct that comprises a gene coding for a fusion protein of the aaT-XTEN composition of the present invention, or its complement. In some embodiments, the cloning strategy is used to create a gene that encodes a monomeric aaT-XTEN that comprises at least a first aaT and at least a first XTEN polypeptide, or their complement. In one embodiment of the foregoing, the gene comprises a sequence encoding an aaT or sequence variant. In other embodiments, the cloning strategy is used to create a gene that encodes a monomeric aaT-XTEN that comprises nucleotides encoding at least a first molecule of aaT or its complement and a first and at least a second XTEN or their complement that is used to transform a host cell for expression of the fusion protein of the aaT-XTEN composition. In the foregoing embodiments hereinabove described in this paragraph, the genes can further comprise nucleotides encoding spacer sequences that also encode cleavage sequence(s).

In designing a desired XTEN sequences, it was discovered that the non-repetitive nature of the XTEN of the inventive compositions is achieved despite use of a "building block" molecular approach in the creation of the XTEN-encoding sequences. This was achieved by the use of a library of polynucleotides encoding peptide sequence motifs, described above, that are then ligated and/or multimerized to create the genes encoding the XTEN sequences (see FIGS. 4, 10, 11, 15 and Examples). Thus, while the XTEN(s) of the expressed fusion protein may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to aaT-XTEN fusion protein. DNA encoding the aaT of the compositions is obtained from a cDNA library prepared using standard methods from tissue or isolated cells believed to possess aaT mRNA and to express it at a detectable level. Libraries are screened with probes containing, for example, about 20 to 100 bases designed to identify the aaT gene of interest by hybridization using conventional molecular biology techniques. The best candidates for probes are those that represent sequences that are highly homologous for alpha 1-antitrypsin, and should be of sufficient length and sufficiently unambiguous that false positives are minimized, but may be degenerate at one or more positions. If necessary, the coding sequence can be obtained using conventional primer extension procedures as described in Sambrook, et al., supra, to detect precursors and processing intermediates of mRNA that may not have been reverse-transcribed into cDNA. One can then use polymerase chain reaction (PCR) methodology to amplify the target DNA or RNA coding sequence to obtain sufficient material for the preparation of the aaT-XTEN constructs containing the aaT gene. Assays can then be conducted to confirm that the hybridizing full-length genes are the desired aaT gene(s). By these conventional methods, DNA can be conveniently obtained from a cDNA library prepared from such sources. The aaT encoding gene(s) is also be obtained from a genomic library or created by standard synthetic procedures known in the art (e.g., automated nucleic acid synthesis using, for example one of the methods described in Engels et al. (Agnew. Chem. Int. Ed. Engl., 28:716-734 1989)), using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the protein of interest or of a fragment or variant of the protein. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein. In one embodiment, the aaT encoding gene encodes a protein from any one of Table 1, or a fragment or variant thereof.

A gene or polynucleotide encoding the aaT portion of the subject aaT-XTEN protein, in the case of an expressed fusion protein that comprises a single aaT is then be cloned into a construct, which is a plasmid or other vector under the control of appropriate transcription and translation sequences for high level protein expression in a biological system. In a later step, a second gene or polynucleotide coding for the XTEN is genetically fused to the nucleotides encoding the N- and/or C-terminus of the aaT gene by cloning it into the construct adjacent and in frame with the gene(s) coding for the aaT. This second step occurs through a ligation or multimerization step. In the foregoing embodiments hereinabove described in this paragraph, it is to be understood that the gene constructs that are created can alternatively be the complement of the respective genes that encode the respective fusion proteins.

The gene encoding for the XTEN can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate short sequences of polynucleotides encoding XTEN into longer XTEN genes of a desired length and sequence. In one embodiment, the method ligates two or more codon-optimized oligonucleotides encoding XTEN motif or segment sequences of about 9 to 14 amino acids, or about 12 to 20 amino acids, or about 18 to 36 amino acids, or about 48 to about 144 amino acids, or about 144 to about 288 or longer, or any combination of the foregoing ranges of motif or segment lengths.

Alternatively, the disclosed method is used to multimerize XTEN-encoding sequences into longer sequences of a desired length; e.g., a gene encoding 36 amino acids of XTEN can be dimerized into a gene encoding 72 amino acids, then 144, then 288, etc. Even with multimerization, XTEN polypeptides can be constructed such that the XTEN-encoding gene has low or virtually no repetitiveness through design of the codons selected for the motifs of the shortest unit being used, which can reduce recombination and increase stability of the encoding gene in the transformed host.

Figure 10:
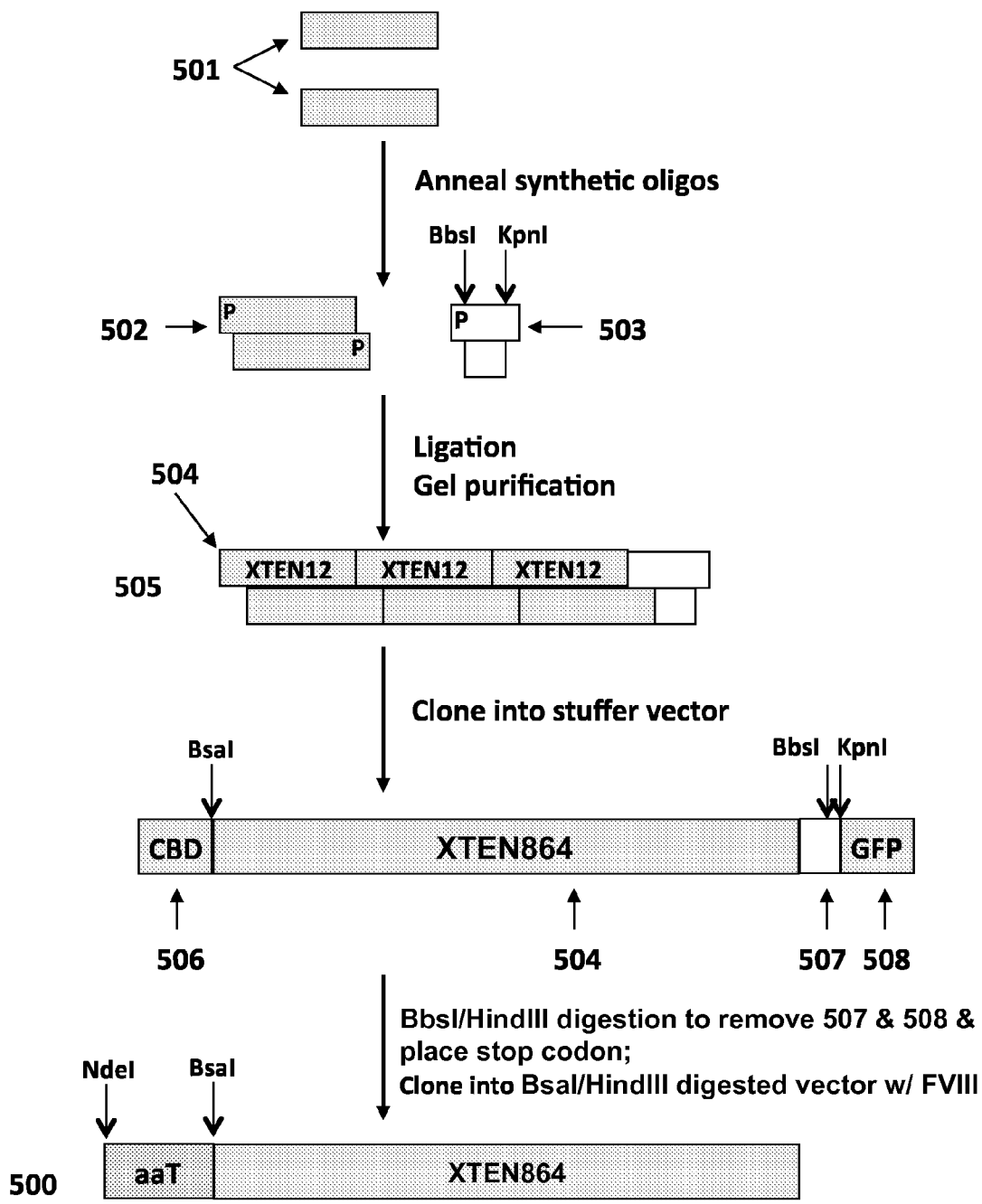
FIG. 10 is a schematic flowchart of representative steps in the assembly of an aaT-XTEN polynucleotide construct encoding a fusion protein. Individual oligonucleotides 501 are annealed into sequence motifs 502 such as a 12 amino acid motif ("12-mer"), which is ligated to additional sequence motifs from a library to create a pool that encompasses the desired length of the XTEN 504, as well as ligated to a smaller concentration of an oligo containing BbsI, and KpnI restriction sites 503. The resulting pool of ligation products is gel-purified and the band with the desired length of XTEN is cut, resulting in an isolated XTEN gene with a stopper sequence 505. The XTEN gene is cloned into a stuffer vector. In this case, the vector encodes an optional CBD sequence 506 and a GFP gene 508. Digestion is then performed with BbsI/HindIII to remove 507 and 508 and place the stop codon. The resulting product is then cloned into a BsaI/HindIII digested vector containing a gene encoding the aaT, resulting in gene 500 encoding an aaT-XTEN fusion protein.

Genes encoding XTEN with non-repetitive sequences are assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as described above. The resulting genes are then assembled with genes encoding aaT or regions of aaT, as illustrated in FIGS. 10, 11 and 13, and the resulting genes used to transform a host cell and produce and recover the aaT-XTEN for evaluation of its properties, as described herein.

In some embodiments, the aaT-XTEN sequence is designed for optimized expression by inclusion of an N-terminal sequence (NTS) XTEN, rather than using a leader sequence known in the art. In one embodiment, the NTS is created by inclusion of encoding nucleotides in the XTEN gene determined to result in optimized expression when joined to the gene encoding the fusion protein. In one embodiment, the N-terminal XTEN sequence of the expressed aaT-XTEN is optimized for expression in a eukaryotic cell, such as but not limited to CHO, HEK, yeast, and other cell types know in the art.

Polynucleotide Libraries

In another aspect, the invention provides libraries of polynucleotides that encode XTEN sequences that are used to assemble genes that encode XTEN of a desired length and sequence.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes, e.g., 12 amino acid motifs can be dimerized and/or ligated into a library of polynucleotides that encode 36 amino acids. Libraries encoding motifs of different lengths; e.g., 9-14 amino acid motifs leading to libraries encoding 27 to 42 amino acids are contemplated by the invention. In turn, the library of polynucleotides that encode 27 to 42 amino acids, and preferably 36 amino acids (as described in the Examples) can be serially dimerized into a library containing successively longer lengths of polynucleotides that encode XTEN sequences of a desired length for incorporation into the gene encoding the aaT-XTEN fusion protein, as disclosed herein.

Figure 15:
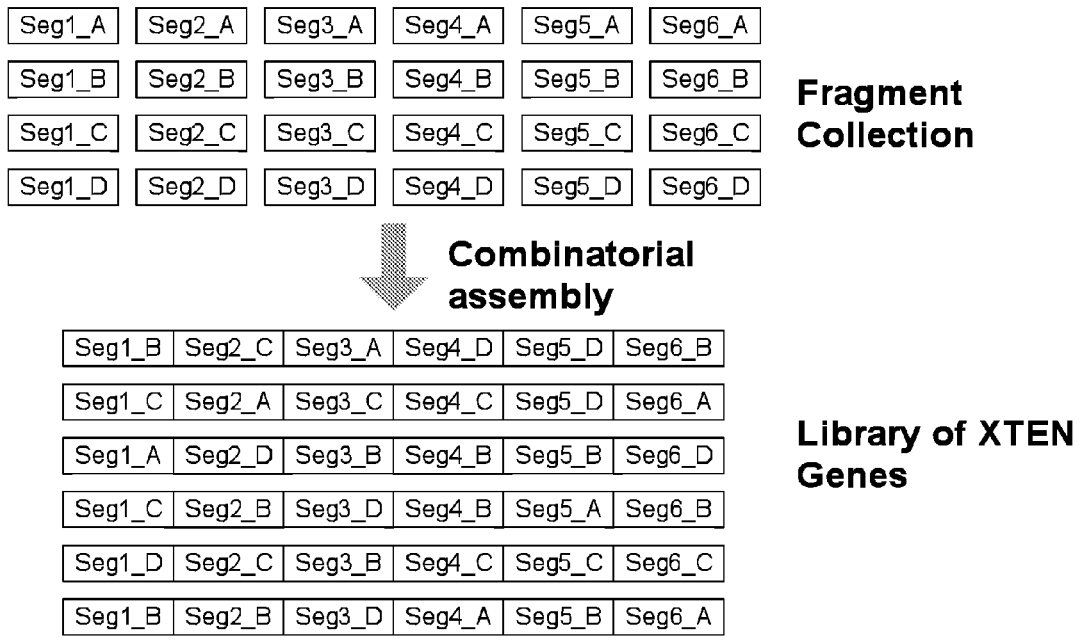
FIG. 15 illustrates the process of combinatorial gene assembly of genes encoding XTEN. In this case, the genes are assembled from 6 base fragments and each fragment is available in 4 different codon versions (A, B, C and D). This allows for a theoretical diversity of 4096 in the assembly of a 12 amino acid motif.

A more efficient way to optimize the DNA sequence encoding XTEN is based on combinatorial libraries. The gene encoding XTEN can be designed and synthesized in segment such that multiple codon versions are obtained for each segment. These segments can be randomly assembled into a library of genes such that each library member encodes the same amino acid sequences but library members comprise a large number of codon versions. Such libraries can be screened for genes that result in high-level expression and/or a low abundance of truncation products. The process of combinatorial gene assembly is illustrated in FIG. 15. The genes in FIG. 15 are assembled from 6 base fragments and each fragment is available in 4 different codon versions. This allows for a theoretical diversity of 4096.

In some embodiments, libraries are assembled of polynucleotides that encode amino acids that are limited to specific sequence XTEN families; e.g., AD, AE, AF, AG, AM, or AQ sequences of Table 3. In other embodiments, libraries comprise sequences that encode two or more of the motif family sequences from Table 3. The names and sequences of representative, non-limiting polynucleotide sequences of libraries that encode 36mers are presented in Tables 8-11, and the methods used to create them are described more fully in the respective Examples. In other embodiments, libraries that encode XTEN are constructed from segments of polynucleotide codons linked in a randomized sequence that encode amino acids wherein at least about 80%, or at least about 90%, or at least about 91%, or at least about 92%, or at least about 93%, or at least about 94%, or at least about 95%, or at least about 97%, or at least about 98%, or at least about 99% of the codons are selected from the group consisting of condons for glycine (G), alanine (A), serine (S), threonine (T), glutamate (E) and proline (P) amino acids. The libraries can be used, in turn, for serial dimerization or ligation to achieve polynucleotide sequence libraries that encode XTEN sequences, for example, of 48, 72, 144, 288, 576, 864, 875, 912, 923, 1318 amino acids, or up to a total length of about 3000 amino acids, as well as intermediate lengths, in which the encoded XTEN can have one or more of the properties disclosed herein, when expressed as a component of an aaT-XTEN fusion protein. In some cases, the polynucleotide library sequences may also include additional bases used as "sequencing islands," described more fully below.

Figure 8:
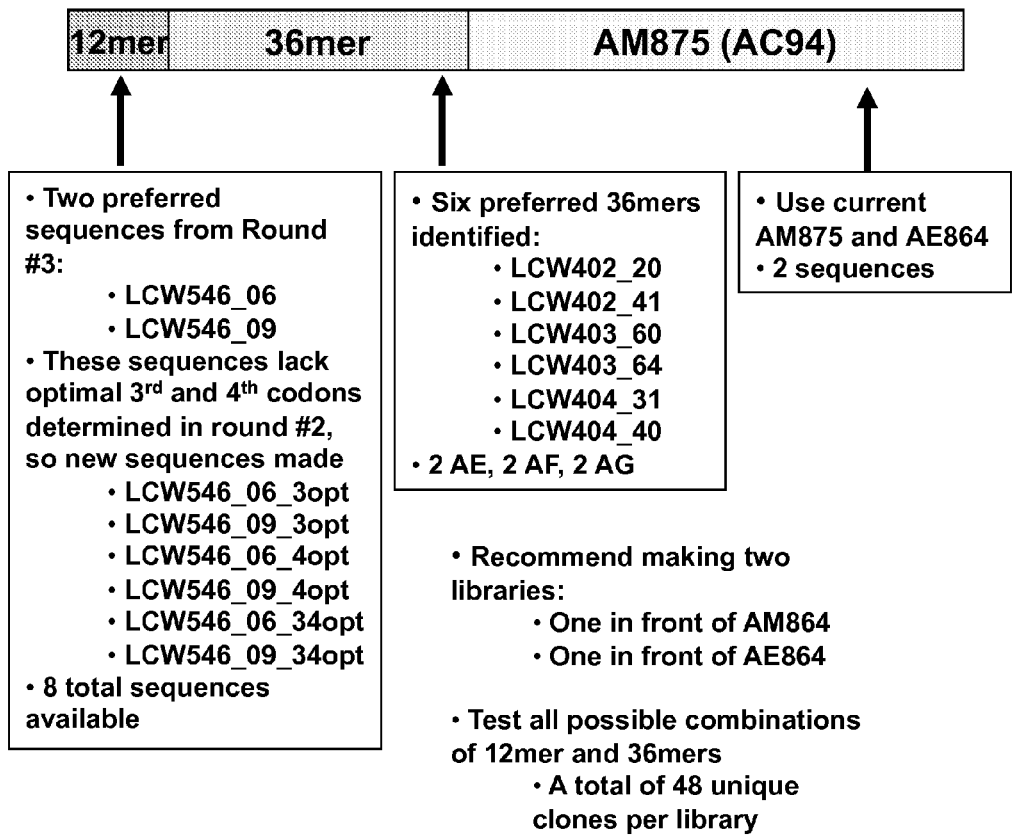
FIG. 8 is a schematic of a combinatorial approach undertaken for the union of codon optimization preferences for two regions of the N-terminus 48 amino acids (described in Example 16). The approach created novel 48mers at the N-terminus of the XTEN protein for the evaluation of the optimization of expression that resulted in leader sequences that may be a solution for expression of XTEN proteins where the XTEN is N-terminal to the biologic payload portion of the fusion protein.

FIG. 8 is a schematic flowchart of representative, non-limiting steps in the assembly of an XTEN polynucleotide construct and an aaT-XTEN polynucleotide construct in the embodiments of the invention. Individual oligonucleotides 501 are annealed into sequence motifs 502 such as a 12 amino acid motif ("12-mer"), which is ligated to additional sequence motifs from a library to create a pool that encompasses the desired length of the XTEN 504, as well as ligated to a smaller concentration of an oligo containing BbsI, and KpnI restriction sites 503. The resulting pool of ligation products is gel-purified and the band with the desired length of XTEN is cut, resulting in an isolated XTEN gene with a stopper sequence 505. The XTEN gene is cloned into a stuffer vector. In this case, the vector encodes an optional CBD sequence 506 and a GFP gene 508. Digestion is than performed with BbsI/HindIII to remove 507 and 508 and place the stop codon. The resulting product is then cloned into a BsaI/HindIII digested vector containing a gene encoding the aaT, resulting in the gene 500 encoding an aaT-XTEN fusion protein. A non-exhaustive list of the polynucleotides encoding XTEN and precursor sequences is provided in Tables 7-12.

TABLE 7

DNA sequences of XTEN and precursor sequences

| XTEN Name | SEQ ID NO: | DNA Nucleotide Sequence |
| --- | --- | --- |
| AE48 | 186 | ATGGCTGAACCTGCTGGCTCTCCAACCTCCACTGAGGAAGGTACCCCGGGTAGCGGTAC TGCTTCTTCCTCTCCAGGTAGCTCTACCCCTTCTGGTGCAACCGGCTCTCCAGGTGCTTCT CCGGGCACCAGCTCTACCGGTTCT |
| AM48 | 187 | ATGGCTGAACCTGCTGGCTCTCCAACCTCCACTGAGGAAGGTGCATCCCCGGGCACCAG CTCTACCGGTTCTCCAGGTAGCTCTACCCCGTCTGGTGCTACCGGCTCTCCAGGTAGCTC TACCCCGTCTGGTGCTACTGGCTCT |
| AE144 | 188 | GGTAGCGAACCGGCAACTTCCGGCTCTGAAACCCCAGGTACTTCTGAAAGCGCTACTCC TGAGTCTGGCCCAGGTAGCGAACCTGCTACCTCTGGCTCTGAAACCCCAGGTAGCCCGG CAGGCTCTCCGACTTCCACCGAGGAAGGTACCTCTACTGAACCTTCTGAGGGTAGCGCT CCAGGTAGCGAACCGGCAACCTCTGGCTCTGAAACCCCAGGTAGCGAACCTGCTACCTC CGGCTCTGAAACTCCAGGTAGCGAACCGGCTACTTCCGGTTCTGAAACTCCAGGTACCT CTACCGAACCTTCCGAAGGCAGCGCACCAGGTACTTCTGAAAGCGCAACCCCTGAATCC GGTCCAGGTAGCGAACCGGCTACTTCTGGCTCTGAGACTCCAGGTACTTCTACCGAACC GTCCGAAGGTAGCGCACCA |
| AF144 | 189 | GGTACTTCTACTCCGGAAAGCGGTTCCGCATCTCCAGGTACTTCTCCTAGCGGTGAATCT TCTACTGCTCCAGGTACCTCTCCTAGCGGCGAATCTTCTACTGCTCCAGGTTCTACCAGC TCTACCGCTGAATCTCCTGGCCCAGGTTCTACCAGCGAATCCCCGTCTGGCACCGCACCA GGTTCTACTAGCTCTACCGCAGAATCTCCGGGTCCAGGTACTTCCCCTAGCGGTGAATCT TCTACTGCTCCAGGTACCTCTACTCCGGAAAGCGGCTCCGCATCTCCAGGTTCTACTAGC TCTACTGCTGAATCTCCTGGTCCAGGTACCTCCCCTAGCGGCGAATCTTCTACTGCTCCA GGTACCTCTCCTAGCGGCGAATCTTCTACCGCTCCAGGTACCTCCCCTAGCGGTGAATCT TCTACCGCACCA |
| AE288 | 190 | GGTACCTCTGAAAGCGCAACTCCTGAGTCTGGCCCAGGTAGCGAACCTGCTACCTCCGG CTCTGAGACTCCAGGTACCTCTGAAAGCGCAACCCCGGAATCTGGTCCAGGTAGCGAAC CTGCAACCTCTGGCTCTGAAACCCCAGGTACCTCTGAAAGCGCTACTCCTGAATCTGGCC CAGGTACTTCTACTGAACCGTCCGAGGGCAGCGCACCAGGTAGCCCTGCTGGCTCTCCA ACCTCCACCGAAGAAGGTACCTCTGAAAGCGCAACCCCTGAATCCGGCCCAGGTAGCGA ACCGGCAACCTCCGGTTCTGAAACCCCAGGTACTTCTGAAAGCGCTACTCCTGAGTCCG GCCCAGGTAGCCCGGCTGGCTCTCCGACTTCCACCGAGGAAGGTAGCCCGGCTGGCTCT CCAACTTCTACTGAAGAAGGTACTTCTACCGAACCTTCCGAGGGCAGCGCACCAGGTAC TTCTGAAAGCGCTACCCCTGAGTCCGGCCCAGGTACTTCTGAAAGCGCTACTCCTGAATC CGGTCCAGGTACTTCTGAAAGCGCTACCCCGGAATCTGGCCCAGGTAGCGAACCGGCTA CTTCTGGTTCTGAAACCCCAGGTAGCGAACCGGCTACCTCCGGTTCTGAAACTCCAGGTA GCCCAGCAGGCTCTCCGACTTCCACTGAGGAAGGTACTTCTACTGAACCTTCCGAAGGC AGCGCACCAGGTACCTCTACTGAACCTTCTGAGGGCAGCGCTCCAGGTAGCGAACCTGC AACCTCTGGCTCTGAAACCCAGGTACCTCTGAAAGCGCTACTCCTGAATCTGGCCCAG GTACTTCTACTGAACCGTCCGAGGGCAGCGCACCA |
| AE576 | 191 | GGTAGCCCGGCTGGCTCTCCTACCTCTACTGAGGAAGGTACTTCTGAAAGCGCTACTCCT GAGTCTGGTCCAGGTACCTCTACTGAACCGTCCGAAGGTAGCGCTCCAGGTAGCCCAGC AGGCTCTCCGACTTCCACTGAGGAAGGTACTTCTACTGAACCTTCCGAAGGCAGCGCAC CAGGTACCTCTACTGAACCTTCTGAGGGCAGCGCTCCAGGTACTTCTGAAAGCGCTACC CCGGAATCTGGCCCAGGTAGCGAACCGGCTACTTCTGGTTCTGAAACCCCAGGTAGCGA ACCGGCTACCTCCGGTTCTGAAACTCCAGGTAGCCCGGCAGGCTCTCCGACCTCTACTGA GGAAGGTACTTCTGAAAGCGCAACCCCGGAGTCCGGCCCAGGTACCTCTACCGAACCGT CTGAGGGCAGCGCACCAGGTACTTCTACCGAACCGTCCGAGGGTAGCGCACCAGGTAGC CCAGCAGGTTCTCCTACCTCCACCGAGGAAGGTACTTCTACCGAACCGTCCGAGGGTAG CGCACCAGGTACCTCTACTGAACCTTCTGAGGGCAGCGCTCCAGGTACTTCTGAAAGCG CTACCCCGGAGTCCGGTCCAGGTACTTCTACTGAACCGTCCGAAGGTAGCGCACCAGGT |

TABLE 7-continued

DNA sequences of XTEN and precursor sequences

| XTEN Name | SEQ ID NO: | DNA Nucleotide Sequence |
|---|---|---|
| | | ACTTCTGAAAGCGCAACCCCTGAATCCGGTCCAGGTAGCGAACCGGCTACTTCTGGCTC<br>TGAGACTCCAGGTACTTCTACCGAACCGTCCGAAGGTAGCGCACCAGGTACTTCTACTG<br>AACCGTCTGAAGGTAGCGCACCAGGTACTTCTGAAAGCGCAACCCCGGAATCCGGCCCA<br>GGTACCTCTGAAAGCGCAACCCCGGAGTCCGGCCCAGGTAGCCCTGCTGGCTCTCCAAC<br>CTCCACCGAAGAAGGTACCTCTGAAAGCGCAACCCCTGAATCCGGCCCAGGTAGCGAAC<br>CGGCAACCTCCGGTTCTGAAACCCCAGGTACCTCTGAAAGCGCTACTCCGGAGTCTGGC<br>CCAGGTACCTCTACTGAACCGTCTGAGGGTAGCGCTCCAGGTACTTCTACTGAACCGTCC<br>GAAGGTAGCGCACCAGGTACTTCTACCGAACCGTCCGAAGGCAGCGCTCCAGGTACCTC<br>TACTGAACCTTCCGAGGGCAGCGCTCCAGGTACCTCTACCGAACCTTCTGAAGGTAGCG<br>CACCAGGTACTTCTACCGAACCGTCCGAGGGTAGCGCACCAGGTAGCCCAGCAGGTTCT<br>CCTACCTCCACCGAGGAAGGTACTTCTACCGAACCGTCCGAGGGTAGCGCACCAGGTAC<br>CTCTGAAAGCGCAACTCCTGAGTCTGGCCCAGGTAGCGAACCTGCTACCTCCGGCTCTG<br>AGACTCCAGGTACCTCTGAAAGCGCAACCCCGGAATCTGGTCCAGGTAGCGAACCTGCA<br>ACCTCTGGCTCTGAAACCCCAGGTACCTCTGAAAGCGCTACTCCTGAATCTGGCCCAGGT<br>ACTTCTACTGAACCGTCGAGGGCAGCGCACCAGGTACTTCTGAAAGCGCTACTCCTGA<br>GTCCGGCCCAGGTAGCCCGGCTGGCTCTCCGACTTCCACCGAGGAAGGTAGCCCGGCTG<br>GCTCTCCAACTTCTACTGAAGAAGGTAGCCCGGCAGGCTCTCCGACCTCTACTGAGGAA<br>GGTACTTCTGAAAGCGCAACCCCGGAGTCCGGCCCAGGTACCTCTACCGAACCGTCTGA<br>GGGCAGCGCACCA |
| AF576 | 192 | GGTTCTACTAGCTCTACCGCTGAATCTCCTGGCCCAGGTTCCACTAGCTCTACCGCAGAA<br>TCTCCGGGCCCAGGTTCTACTAGCGAATCCCCTTCTGGTACCGCTCCAGGTTCTACTAGC<br>TCTACCGCTGAATCTCCGGGTCCAGGTTCTACCAGCTCTACTGCAGAATCTCCTGGCCCA<br>GGTACTTCTACTCCGGAAAGCGGTTCCGCTTCTCCAGGTTCTACCAGCGAATCTCCTTCT<br>GGCACCGCTCCAGGTACCTCTCCTAGCGGCGAATCTTCTACCGCTCCAGGTTCTACTAGC<br>GAATCTCCTTCTGGCACTGCACCAGGTTCTACCAGCGAATCTCCTTCTGGCACCGCTCCA<br>GGTACCTCTCCTAGCGGCGAATCTTCTACCGCTCCAGGTTCTACTAGCGAATCTCCTTCT<br>GGCACTGCACCAGGTTCTACCAGCGAATCTCCTTCTGGCACCGCTCCAGGTACCTCTCCT<br>AGCGGCGAATCTTCTACCGCTCCAGGTTCTACTAGCGAATCTCCTTCTGGCACTGCACCA<br>GGTTCTACTAGCGAATCTCCTTCTGGCACTGCACCAGGTTCTACCAGCGAATCTCCGTCT<br>GGCACTGCACCAGGTACCTCTACCCCTGAAAGCGGTTCCGCTTCTCCAGGTTCTACTAGC<br>GAATCTCCTTCTGGTACCGCTCCAGGTACTTCTACCCCTGAAAGCGGCTCCGCTTCTCCA<br>GGTTCCACTAGCTCTACCGCTGAATCTCCGGGTCCAGGTTCTACTAGCTCTACTGCAGAA<br>TCTCCTGGCCCAGGTACCTCTACTCCGGAAAGCGGCTCTGCATCTCCAGGTACTTCTACC<br>CCTGAAAGCGGTTCTGCATCTCCAGGTTCTACTAGCGAATCCCCGTCTGGTACCGCACCA<br>GGTACTTCTACCCCGGAAAGCGGCTCTGCTTCTCCAGGTACTTCTACCCCGGAAAGCGGC<br>TCCGCATCTCCAGGTTCTACTAGCGAATCTCCTTCTGGTACCGCTCCAGGTTCTACCAGC<br>GAATCCCGTCTGGTACTGCTCCAGGTTCTACCAGCGAATCTCCTTCTGGTACTGCACCA<br>GGTTCTACTAGCTCTACTGCAGAATCTCCTGGCCCAGGTACCTCTACTCCGGAAAGCGGC<br>TCTGCATCTCCAGGTACTTCTACCCCTGAAAGCGGTTCTGCTTCTCCAGGTTCTACTAGC<br>GAATCTCCTTCTGGCACTGCACCAGGTTCTACCAGCGAATCTCCGTCTGGCACTGCACCA<br>GGTACCTCTACCCCTGAAAGCGGTTCCGCTTCTCCAGGTTCTACTAGCGAATCTCCTTCT<br>GGCACTGCACCAGGTTCTACCAGCGAATCTCCGTCTGGCACTGCACCAGGTACCTCTACC<br>CCTGAAAGCGGTTCCGCTTCTCCAGGTACTTCTCCGAGCGGTGAATCTTCTACCGCACCA<br>GGTTCTACTAGCTCTACCGCTGAATCTCCGGGCCCAGGTACTTCTCCGAGCGGTGAATCT<br>TCTACTGCTCCAGGTTCCACTAGCTCTACTGCTGAATCTCCTGGCCCAGGTACTTCTACTC<br>CGGAAAGCGGTTCCGCTTCTCCAGGTTCTACTAGCGAATCTCCGTCTGGCACCGCACCAG<br>GTTCTACTAGCTCTACTGCAGAATCTCCTGGCCCAGGTACCTCTACTCCGGAAAGCGGCT<br>CTGCATCTCCAGGTACTTCTACCCCTGAAAGCGGTTCTGCATCTCCA |
| AE624 | 193 | ATGGCTGAACCTGCTGGCTCTCCAACCTCCACTGAGGAAGGTACCCCGGGTAGCGGTAC<br>TGCTTCTTCCTCTCCAGGTAGCTCTACCCCTTCTGGTGCAGCCGGCTCTCCAGGTGCTTCT<br>CCGGGCACCAGCTCTACCGGTTCTCCAGGTAGCCCGGCTGGCTCTCCTACCTCTACTGAG<br>GAAGGTACTTCTGAAAGCGCTACTCCTGAGTCTGGTCCAGGTACCTCTACTGAACCGTCC<br>GAAGGTAGCGCTCCAGGTAGCCCAGCAGGCTCTCCGACTTCCACTGAGGAAGGTACTTC<br>TACTGAACCTTCCGAAGGCAGCGCACCAGGTACCTCTACTGAACCTTCTGAGGGCAGCG<br>CTCCAGGTACTTCTGAAAGCGCTACCCCGGAATCTGGCCCAGGTAGCGAACCGGCTACT<br>TCTGGTTCTGAAACCCCAGGTAGCGAACCGGCTACCTCCGGTTCTGAAACTCCAGGTAG<br>CCCGGCAGGCTCTCCGACCTCTACTGAGGAAGGTACTTCTGAAAGCGCAACCCCGGAGT<br>CCGGCCCAGGTACCTCTACCGAACCGTCTGAGGGCAGCGCACCAGGTACTTCTACCGAA<br>CCGTCCGAGGGTAGCGCACCAGGTAGCCCAGCAGGTTCTCCTACCTCCACCGAGGAAGG<br>TACTTCTACCGAACCGTCCGAGGGTAGCGCACCAGGTACCTCTACTGAACCTTCTGAGG<br>GCAGCGCTCCAGGTACTTCTGAAAGCGCTACCCCGGAGTCCGGTCAGGTACTTCTACT<br>GAACCGTCCGAAGGTAGCGCACCAGGTACTTCTGAAAGCGCAACCCCTGAATCCGGTCC<br>AGGTAGCGAACCGGCTACTTCTGGCTCTGAGACTCCAGGTACTTCTACCGAACCGTCCG<br>AAGGTAGCGCACCAGGTACTTCTGAACCGTCTGAAGGTAGCGCACCAGGTACTTCT<br>GAAAGCGCAACCCCGGAATCCGGCCCAGGTACCTCTGAAAGCGCAACCCCGGAGTCCG<br>GCCCAGGTAGCCCTGCTGGCTCTCCAACCTCCACCGAAGAAGGTACCTCTGAAAGCGCA<br>ACCCCTGAATCCGGCCCAGGTAGCGAACCGGCAACCTCCGGTTCTGAAACCCCAGGTAC<br>CTCTGAAAGCGCTACTCCGGAGTCTGGCCCAGGTACCTCTACTGAACCGTCTGAGGGTA<br>GCGCTCCAGGTACTTCTACTGAACCGTCCGAAGGTAGCGCACCAGGTACTTCTACCGAA<br>CCGTCCGAAGGCAGCGCTCCAGGTACCTCTACTGAACCTTCCGAGGGCAGCGCTCCAGG<br>TACCTCTACCGAACCTTCTGAAGGTAGCGCACCAGGTACTTCTACCGAACCGTCCGAGG<br>GTAGCGCACCAGGTAGCCCAGCAGGTTCTCCTACCTCCACCGAGGAAGGTACTTCTACC |

TABLE 7-continued

DNA sequences of XTEN and precursor sequences

| XTEN Name | SEQ ID NO: | DNA Nucleotide Sequence |
|---|---|---|
| | | GAACCGTCCGAGGGTAGCGCACCAGGTACCTCTGAAAGCGCAACTCCTGAGTCTGGCCC<br>AGGTAGCGAACCTGCTACCTCCGGCTCTGAGACTCCAGGTACCTCTGAAAGCGCAACCC<br>CGGAATCTGGTCCAGGTAGCGAACCTGCAACCTCTGGCTCTGAAACCCCAGGTACCTCT<br>GAAAGCGCTACTCCTGAATCTGGCCCAGGTACTTCTACTGAACCGTCCGAGGGCAGCGC<br>ACCAGGTACTTCTGAAAGCGCTACTCCTGAGTCCGGCCCAGGTAGCCCGGCTGGCTCTC<br>CGACTTCCACCGAGGAAGGTAGCCCGGCTGGCTCTCCAACTTCTACTGAAGAAGGTAGC<br>CCGGCAGGCTCTCCGACCTCTACTGAGGAAGGTACTTCTGAAAGCGCAACCCCGGAGTC<br>CGGCCCAGGTACCTCTACCGAACCGTCTGAGGGCAGCGCACCA |
| AM875 | 194 | GGTACTTCTACTGAACCGTCTGAAGGCAGCGCACCAGGTAGCGAACCGGCTACTTCCGG<br>TTCTGAAACCCCAGGTAGCCCAGCAGGTTCTCCAACTTCTACTGAAGAAGGTTCTACCA<br>GCTCTACCGCAGAATCTCCTGGTCCAGGTACCTCTACTCCGGAAAGCGGCTCTGCATCTC<br>CAGGTTCTACTAGCGAATCTCCTTCTGGCACTGCACCAGGTTCTACTAGCGAATCCCCGT<br>CTGGTACTGCTCCAGGTACTTCTACTCCTGAAAGCGGTTCCGCTTCTCCAGGTACCTCTA<br>CTCCGGAAAGCGGTTCTGCATCTCCAGGTAGCGAACCGGCAACCTCCGGCTCTGAAACC<br>CCAGGTACCTCTGAAAGCGCTACTCCTGAATCCGGCCCAGGTAGCCCGGCAGGTTCTCC<br>GACTTCCACTGAGGAAGGTACCTCTACTGAACCTTCTGAGGGCAGCGCTCCAGGTACTT<br>CTGAAAGCGCTACCCCGGAGTCCGGTCCAGGTACTTCTACTGAACCGTCCGAAGGTAGC<br>GCACCAGGTACTTCTACCGAACCGTCCGAGGGTAGCGCACCAGGTAGCCCAGCAGGTTC<br>TCCTACCTCCACCGAGGAAGGTACTTCTACCGAACCGTCCGAGGGTAGCGCACCAGGTA<br>CTTCTACCGAACCTTCCGAGGGCAGCGCACCAGGTACTTCTGAAAGCGCTACCCCTGAG<br>TCCGGCCCAGGTACTTCTGAAAGCGCTACTCCTGAATCCGGTCCAGGTACCTCTACTGAA<br>CCTTCCGAAGGCAGCGCTCCAGGTACCTCTACCGAACCGTCCGAGGGCAGCGCACCAGG<br>TACTTCTGAAAGCGCAACCCCTGAATCCGGTCCAGGTACTTCTACTGAACCTTCCGAAGG<br>TAGCGCTCCAGGTAGCGAACCTGCTACTTCTGGTTCTGAAACCCAGGTAGCCCGGCTG<br>GCTCTCCGACCTCCACCGAGGAAGGTAGCTCTACCCCGTCTGGTGCTACTGGTTCTCCAG<br>GTACTCCGGGCAGCGGTACTGCTTCTTCCTCTCCAGGTAGCTCTACCCCTTCTGGTGCTA<br>CTGGCTCTCCAGGTACCTCTACCGAACCGTCCGAGGGTAGCGCACCAGGTACCTCTACT<br>GAACCGTCTGAGGGTAGCGCTCCAGGTAGCGAACCGGCAACCTCCGGTTCTGAAACTCC<br>AGGTAGCCCTGCTGGCTCTCCGACTTCTACTGAGGAAGGTAGCCCGGCTGGTTCTCCGAC<br>TTCTACTGAGGAAGGTACTTCTACCGAACCTTCCGAAGGTAGCGCTCCAGGTGCAAGCG<br>CAAGCGGCGCGCCAAGCACGGGAGGTACTTCTGAAAGCGCTACTCCTGAGTCCGGCCCA<br>GGTAGCCCGGCTGGCTCTCCGACTTCCACCGAGGAAGGTAGCCCGGCTGGCTCTCCAAC<br>TTCTACTGAAGAAGGTTCTACCAGCTCTACCGCTGAATCTCCTGGCCCAGGTTCTACTAG<br>CGAATCTCCGTCTGGCACCGCACCAGGTACTTCCCCTAGCGGTGAATCTTCTACTGCACC<br>AGGTACCCCTGGCAGCGGTACCGCTTCTTCCTCTCCAGGTAGCTCTACCCCGTCTGGTGC<br>TACTGGCTCTCCAGGTTCTAGCCCGTCTGCATCTACCGGTACCGGCCCAGGTAGCGAACC<br>GGCAACCTCCGGCTCTGAAACTCCAGGTACTTCTGAAAGCGCTACTCCGGAATCCGGCC<br>CAGGTAGCGAACCGGCTACTTCCGGCTCTGAAACCCCAGGTTCCACCAGCTCTACTGCA<br>GAATCTCCGGGCCCAGGTTCTACTAGCTCTACTGCAGAATCTCCGGGTCCAGGTACTTCT<br>CCTAGCGGCGAATCTTCTACCGCTCCAGGTAGCGAACCGGCAACCTCTGGCTCTGAAAC<br>TCCAGGTAGCGAACCTGCAACCTCCGGCTCTGAAACCCCAGGTACTTCTACTGAACCTTC<br>TGAGGGCAGCGCACCAGGTTCTACCAGCTCTACCGCAGAATCTCCTGGTCCAGGTACCT<br>CTACTCCGGAAAGCGGCTCTGCATCTCCAGGTTCTACTAGCGAATCTCCTTCTGGCACTG<br>CACCAGGTACTTCTACCGAACCGTCCGAAGGCAGCGCTCCAGGTACCTCTACTGAACCT<br>TCCGAGGGCAGCGCTCCAGGTACCTCTACCGAACCTTCTGAAGGTAGCGCACCAGGTAG<br>CTCTACTCCGTCTGGTGCAACCGGCTCCCCAGGTTCTAGCCCGTCTGCTTCCACTGGTAC<br>TGGCCCAGGTGCTTCCCCGGGCACCAGCTCTACTGGTTCTCCAGGTAGCGAACCTGCTAC<br>CTCCGGTTCTGAAACCCCAGGTACCTCTGAAAGCGCAACTCCGGAGTCTGGTCCAGGTA<br>GCCCTGCAGGTTCTCCTACCTCCACTGAGGAAGGTAGCTCTACTCCGTCTGGTGCAACCG<br>GCTCCCCAGGTTCTAGCCCGTCTGCTTCCACTGGTACTGGCCCAGGTGCTTCCCGGGCA<br>CCAGCTCTACTGGTTCTCCAGGTACCTCTGAAAGCGCTACTCCGGAGTCTGGCCCAGGTA<br>CCTCTACTGAACCGTCTGAGGGTAGCGCTCCAGGTACTTCTACTGAACCGTCCGAAGGT<br>AGCGCACCA |
| AE864 | 195 | GGTAGCCCGGCTGGCTCTCCTACCTCTACTGAGGAAGGTACTTCTGAAAGCGCTACTCCT<br>GAGTCTGGTCCAGGTACCTCTACTGAACCGTCCGAAGGTAGCGCTCCAGGTAGCCCAGC<br>AGGCTCTCCGACTTCCACTGAGGAAGGTACTTCTACTGAACCTTCCGAAGGCAGCGCAC<br>CAGGTACCTCTACTGAACCTTCTGAGGGCAGCGCTCCAGGTACTTCTGAAAGCGCTACC<br>CCGGAATCTGGCCCAGGTAGCGAACCGGCTACTTCTGGTTCTGAAACCCAGGTAGCGA<br>ACCGGCTACCTCCGGTTCTGAAACTCCAGGTAGCCCGGCTGGCTCTCCGACCTCTACTGA<br>GGAAGGTACTTCTGAAAGCGCAACCCCGGAGTCCGGCCCAGGTACCTCTACCGAACCGT<br>CTGAGGGCAGCGCACCAGGTACTTCTACCGAACCGTCCGAGGGTAGCGCACCAGGTAGC<br>CCAGCAGGTTCTCCTACCTCCACCGAGGAAGGTACTTCTACCGAACCGTCCGAGGGTAG<br>CGCACCAGGTACCTCTACTGAACCTTCTGAGGGCAGCGCTCCAGGTACTTCTGAAAGCG<br>CTACCCCGGAGTCCGGTCCAGGTACTTCTACTGAACCGTCCGAAGGTAGCGCACCAGGT<br>ACTTCTGAAAGCGCAACCCCTGAATCCGGTCCAGGTAGCGAACCGGCTACTTCTGGCTC<br>TGAGACTCCAGGTACTTCTACCGAACCGTCCGAAGGTAGCGCACCAGGTACTTCTACTG<br>AACCGTCTGAAGGTAGCGCACCAGGTACTTCTGAAAGCGCTACCCCGGAGTCCGGCCCA<br>GGTACCTCTGAAAGCGCAACCCCGGAGTCCGGCCCAGGTAGCCCTGCTGGCTCTCCAAC<br>CTCCACCGAAGAAGGTACCTCTGAAAGCGCAACCCCTGAATCCGGCCCAGGTAGCGAAC<br>CGGCAACCTCCGGTTCTGAAACCCAGGTACCTCTGAAAGCGCTACTCCGGAGTCTGGC<br>CCAGGTACCTCTACTGAACCGTCTGAGGGTAGCGCTCCAGGTACTTCTACTGAACCGTCC<br>GAAGGTAGCGCACCAGGTACTTCTACCGAACCGTCCGAAGGCAGCGCTCCAGGTACCTC |

TABLE 7-continued

DNA sequences of XTEN and precursor sequences

| XTEN Name | SEQ ID NO: | DNA Nucleotide Sequence |
|---|---|---|
| | | TACTGAACCTTCCGAGGGCAGCGCTCCAGGTACCTCTACCGAACCTTCTGAAGGTAGCG<br>CACCAGGTACTTCTACCGAACCGTCCGAGGGTAGCGCACCAGGTAGCCCAGCAGGTTCT<br>CCTACCTCCACCGAGGAAGGTACTTCTACCGAACCGTCCGAGGGTAGCGCACCAGGTAC<br>CTCTGAAAGCGCAACTCCTGAGTCTGGCCCAGGTAGCGAACCTGCTACCTCCGGCTCTG<br>AGACTCCAGGTACCTCTGAAAGCGCAACCCCGGAATCTGGTCCAGGTAGCGAACCTGCA<br>ACCTCTGGCTCTGAAACCCCAGGTACCTCTGAAAGCGCTACTCCTGAATCTGGCCCAGGT<br>ACTTCTACTGAACCGTCCGAGGGCAGCGCACCAGGTACTTCTGAAAGCGCTACTCCTGA<br>GTCCGGCCCAGGTAGCCCGGCTGGCTCTCCGACTTCCACCGAGGAAGGTAGCCCGGCTG<br>GCTCTCCAACTTCTACTGAAGAAGGTAGCCCGGCAGGCTCTCCGACCTCTACTGAGGAA<br>GGTACTTCTGAAAGCGCAACCCCGGAGTCCGGCCCAGGTACCTCTACCGAACCGTCTGA<br>GGGCAGCGCACCAGGTACCTCTGAAAGCGCAACTCCTGAGTCTGGCCCAGGTAGCGAAC<br>CTGCTACCTCCGGCTCTGAGACTCCAGGTACCTCTGAAAGCGCAACCCCGGAATCTGGT<br>CCAGGTAGCGAACCTGCAACCTCTGGCTCTGAAACCCCAGGTACCTCTGAAAGCGCTAC<br>TCCTGAATCTGGCCCAGGTACTTCTACTGAACCGTCCGAGGGCAGCGCACCAGGTAGCC<br>CTGCTGGCTCTCCAACCTCCACCGAAGAAGGTACCTCTGAAAGCGCAACCCCTGAATCC<br>GGCCCAGGTAGCGAACCGGCAACCTCCGGTTCTGAAACCCCAGGTACTTCTGAAAGCGC<br>TACTCCTGAGTCCGGCCCAGGTAGCCCGGCTGGCTCTCCGACTTCCACCGAGGAAGGTA<br>GCCCGGCTGGCTCTCCAACTTCTACTGAAGAAGGTACTTCTACCGAACCTTCCGAGGGC<br>AGCGCACCAGGTACTTCTGAAAGCGCTACCCCTGAGTCCGGCCCAGGTACTTCTGAAAG<br>CGCTACTCCTGAATCCGGTCCAGGTACTTCTGAAAGCGCTACCCCGGAATCTGGCCCAG<br>GTAGCGAACCGGCTACTTCTGGTTCTGAAACCCCAGGTAGCGAACCGGCTACCTCCGGT<br>TCTGAAACTCCAGGTAGCCCAGCAGGCTCTCCGACTTCCACTGAGGAAGGTACTTCTACT<br>GAACCTTCCGAAGGCAGCGCACCAGGTACCTCTACTGAACCTTCTGAGGGCAGCGCTCC<br>AGGTAGCGAACCTGCAACCTCTGGCTCTGAAACCCCAGGTACCTCTGAAAGCGCTACTC<br>CTGAATCTGGCCCAGGTACTTCTACTGAACCGTCCGAGGGCAGCGCACCA |
| AF864 | 196 | GGTTCTACCAGCGAATCTCCTTCTGGCACCGCTCCAGGTACCTCTCCTAGCGGCGAATCT<br>TCTACCGCTCCAGGTTCTACTAGCGAATCTCCTTCTGGCACTGCACCAGGTTCTACTAGC<br>GAATCCCGTCTGGTACTGCTCCAGGTACTTCTACTCCTGAAAGCGGTTCCGCTTCTCCA<br>GGTACCTCTACTCCGGAAAGCGGTTCTGCATCTCCAGGTTCTACCAGCGAATCTCCTTCT<br>GGCACCGCTCCAGGTTCTACTAGCGAATCCCGTCTGGTACCGCACCAGGTACTTCTCCT<br>AGCGGCGAATCTTCTACCGCACCAGGTTCTACTAGCGAATCTCCGTCTGGCACTGCTCCA<br>GGTACTTCTCCTAGCGGTGAATCTTCTACCGCTCCAGGTACTTCCCCTAGCGGCGAATCT<br>TCTACCGCTCCAGGTTCTACTAGCTCTACTGCAGAATCTCCGGGCCCAGGTACCTCTCCT<br>AGCGGTGAATCTTCTACCGCTCCAGGTACTTCTCCGAGCGGTGAATCTTCTACCGCTCCA<br>GGTTCTACTAGCTCTACTGCAGAATCTCCTGGCCCAGGTACCTCTACTCCGGAAAGCGGC<br>TCTGCATCTCCAGGTACTTCTACCCCTGAAAGCGGTTCTGCATCTCCAGGTTCTACTAGC<br>GAATCTCCTTCTGGCACTGCACCAGGTTCTACCAGCGAATCTCCGTCTGGCACTGCACCA<br>GGTACCTCTACCCCTGAAAGCGGTTCCGCTTCTCCAGGTTCTACCAGCTCTACCGCAGAA<br>TCTCCTGGTCCAGGTACCTCTACTCCGGAAAGCGGCTCTGCATCTCCAGGTTCTACTAGC<br>GAATCTCCTTCTGGCACTGCACCAGGTACTTCTCCGAGCGGTGAATCTTCTACCGCACCA<br>GGTTCTACTAGCTCTACCGCTGAATCTCCGGGCCCAGGTACTTCTCCGAGCGGTGAATCT<br>TCTACTGCTCCAGGTACCTCTACTCCTGAAAGCGGTTCTGCATCTCCAGGTTCCACTAGC<br>TCTACCGCAGAATCTCCGGGCCCAGGTTCTACTAGCTCTACTGCTGAATCTCCTGGCCCA<br>GGTTCTACTAGCTCTACTGCTGAATCTCCGGGTCCAGGTTCTACCAGCTCTACTGCTGAA<br>TCTCCTGGTCCAGGTACCTCCCCGAGCGGTGAATCTTCTACTGCACCAGGTTCTACTAGC<br>GAATCTCCTTCTGGCACTGCACCAGGTTCTACCAGCGAATCTCCGTCTGGCACTGCACCA<br>GGTACCTCTACCCCTGAAAGCGGTCCXXXXXXXXXXXXTGCAAGCGCAAGCGGCGCGC<br>CAAGCACGGGAXXXXXXXXXTAGCGAATCTCCTTCTGGTACCGCTCCAGGTTCTACCAGC<br>GAATCCCGTCTGGTACTGCTCCAGGTTCTACCAGCGAATCTCCTTCTGGTACTGCACCA<br>GGTTCTACTAGCGAATCTCCTTCTGGTACCGCTCCAGGTTCTACCAGCGAATCCCGTCT<br>GGTACTGCTCCAGGTTCTACCAGCGAATCTCCTTCTGGTACTGCACCAGGTACTTCTACT<br>CCGGAAAGCGGTTCCGCATCTCCAGGTACTTCTCCTAGCGGTGAATCTTCTACTGCTCCA<br>GGTACCTCTCCTAGCGGCGAATCTTCTACTGCTCCAGGTTCTACCAGCTCTACTGCTGAA<br>TCTCCGGGTCCAGGTACTTCCCCGAGCGGTGAATCTTCTACTGCACCAGGTACTTCTACT<br>CCGGAAAGCGGTTCCGCTTCTCCAGGTTCTACCAGCGAATCTCCTTCTGGCACCGCTCCA<br>GGTTCTACTAGCGAATCCCGTCTGGTACCGCACCAGGTACTTCTCCTAGCGGCGAATCT<br>TCTACCGCACCAGGTTCTACTAGCGAATCCCGTCTGGTACCGCACCAGGTACTTCTACC<br>CCGGAAAGCGGCTCTGCTTCTCCAGGTACTTCTACCCCGGAAAGCGGCTCCGCATCTCCA<br>GGTTCTACTAGCGAATCTCCTTCTGGTACCGCTCCAGGTACTTCTACCCCTGAAAGCGGC<br>TCCGCTTCTCCAGGTTCCACTAGCTCTACCGCTGAATCTCCGGGTCCAGGTTCTACCAGC<br>GAATCTCCTTCTGGCACCGCTCCAGGTTCTACTAGCGAATCCCGTCTGGTACCGCACCA<br>GGTACTTCTCCTAGCGGCGAATCTTCTACCGCACCAGGTTCTACCAGCTCTACTGCTGAA<br>TCTCCGGGTCCAGGTACTTCCCCGAGCGGTGAATCTTCTACTGCACCAGGTACTTCTACT<br>CCGGAAAGCGGTTCCGCTTCTCCAGGTACCTCCCTAGCGGCGAATCTTCTACTGCTCCA<br>GGTACCTCTCCTAGCGGCGAATCTTCTACCGCTCCAGGTACCTCCCCTAGCGGTGAATCT<br>TCTACCGCACCAGGTTCTACTAGCTCTACTGCTGAATCTCCGGGTCCAGGTTCTACCAGC<br>TCTACTGCTGAATCTCCTGGTCCAGGTACCTCCCCGAGCGGTGAATCTTCTACTGCACCA<br>GGTTCTAGCCCTTCTGCTTCCACCGGTACCGGCCCAGGTAGCTCTACTCCGTCTGGTGCA<br>ACTGGCTCTCCAGGTAGCTCTACTCCGTCTGGTGCAACCGGCTCCCCA<br>XXXX was inserted in two areas where no sequence information is available. |

TABLE 7-continued

DNA sequences of XTEN and precursor sequences

| XTEN Name | SEQ ID NO: | DNA Nucleotide Sequence |
|---|---|---|
| AG864 | 197 | GGTGCTTCCCCGGGCACCAGCTCTACTGGTTCTCCAGGTTCTAGCCCGTCTGCTTCTACT<br>GGTACTGGTCCAGGTTCTAGCCCTTCTGCTTCCACTGGTACTGGTCCAGGTACCCCGGGT<br>AGCGGTACCGCTTCTTCTTCTCCAGGTAGCTCTACTCCGTCTGGTGCTACCGGCTCTCCA<br>GGTTCTAACCCTTCTGCATCCACCGGTACCGGCCCAGGTGCTTCTCCGGGCACCAGCTCT<br>ACTGGTTCTCCAGGTACCCCGGGCAGCGGTACCGCATCTTCTTCTCCAGGTAGCTCTACT<br>CCTTCTGGTGCAACTGGTTCTCCAGGTACTCCTGGCAGCGGTACCGCTTCTTCTTCTCCA<br>GGTGCTTCTCCTGGTACTAGCTCTACTGGTTCTCCAGGTGCTTCTCCGGGCACTAGCTCT<br>ACTGGTTCTCCAGGTACCCCGGGTAGCGGTACTGCTTCTTCCTCTCCAGGTAGCTCTACC<br>CCTTCTGGTGCAACCGGCTCTCCAGGTGCTTCTCCGGGCACCAGCTCTACCGGTTCTCCA<br>GGTACCCCGGGTAGCGGTACCGCTTCTTCTTCTCCAGGTAGCTCTACTCCGTCTGGTGCT<br>ACCGGCTCTCCAGGTTCTAACCCTTCTGCATCCACCGGTACCGGCCCAGGTTCTAGCCCT<br>TCTGCTTCCACCGGTACTGGCCCAGGTAGCTCTACCCCTTCTGGTGCTACCGGCTCCCCA<br>GGTAGCTCTACTCCTTCTGGTGCAACTGGCTCTCAGGTGCATCTCCGGGCACTAGCTCT<br>ACTGGTTCTCCAGGTGCATCCCCTGGCACTAGCTCTACTGGTTCTCCAGGTGCTTCTCCT<br>GGTACCAGCTCTACTGGTTCTCCAGGTACTCCTGGCAGCGGTACCGCTTCTTCTTCTCCA<br>GGTGCTTCTCCTGGTACTAGCTCTACTGGTTCTCCAGGTGCTTCTCCGGGCACTAGCTCT<br>ACTGGTTCTCCAGGTGCTTCCCCGGGCACTAGCTCTACCGGTTCTCCAGGTTCTAGCCCT<br>TCTGCATCTACTGGTACTGGCCCAGGTACTCCGGGCAGCGGTACTGCTTCTTCCTCTCCA<br>GGTGCATCTCCGGGCACTAGCTCTACTGGTTCTCCAGGTGCATCCCCTGGCACTAGCTCT<br>ACTGGTTCTCCAGGTGCTTCTCCTGGTACCAGCTCTACTGGTTCTCCAGGTAGCTCTACTC<br>CGTCTGGTGCAACCGGTTCCCCAGGTAGCTCTACTCCTTCTGGTGCTACTGGCTCCCCAG<br>GTGCATCCCCTGGCACCAGCTCTACCGGTTCTCCAGGTACCCCGGGCAGCGGTACCGCA<br>TCTTCCTCTCCAGGTAGCTCTACCCCGTCTGGTGCTACCGGTTCCCCAGGTAGCTCTACC<br>CCGTCTGGTGCAACCGGCTCCCCAGGTAGCTCTACTCCGTCTGGTGCAACCGGCTCCCCA<br>GGTTCTAGCCCGTCTGCTTCCACTGGTACTGGCCCAGGTGCTTCCCCGGGCACCAGCTCT<br>ACTGGTTCTCCAGGTGCATCCCGGGTACCAGCTCTACCGGTTCTCCAGGTACTCCTGGC<br>AGCGGTACTGCATCTTCCTCTCCAGGTGCTTCTCCGGGCACCAGCTCTACTGGTTCTCCA<br>GGTGCATCTCCGGGCACTAGCTCTACTGGTTCTCCAGGTGCATCCCCTGGCACTAGCTCT<br>ACTGGTTCTCCAGGTGCTTCTCCTGGTACCAGCTCTACTGGTTCTCCAGGTACCCCTGGT<br>AGCGGTACTGCTTCTTCCTCTCCAGGTAGCTCTACTCCGTCTGGTGCTACCGGTTCTCCA<br>GGTACCCCGGGTAGCGGTACCGCATCTTCTTCTCCAGGTAGCTCTACCCCGTCTGGTGCT<br>ACTGGTTCTCCAGGTACTCCGGGCAGCGGTACTGCTTCTTCCTCTCCAGGTAGCTCTACC<br>CCTTCTGGTGCTACTGGCTCTCCAGGTAGCTCTACCCCGTCTGGTGCTACTGGCTCCCCA<br>GGTTCTAGCCCTTCTGCATCCACCGGTACCGGTCAGGTTCTAGCCCGTCTGCATCTACT<br>GGTACTGGTCCAGGTGCATCCCCGGGCACTAGCTCTACCGGTTCTCCAGGTACTCCTGGT<br>AGCGGTACTGCTTCTTCTTCTCCAGGTAGCTCTACTCCTTCTGGTGCTACTGGTTCTCCAG<br>GTTCTAGCCCTTCTGCATCCACCGGTACCGGCCCAGGTTCTAGCCCGTCTGCTTCTACCG<br>GTACTGGTCAGGTGCTTCTCGGGTACTAGCTCTACTGGTTCTCCAGGTGCATCTCCTG<br>GTACTAGCTCTACTGGTTCTCCAGGTAGCTCTACTCCGTCTGGTGCAACCGGCTCTCCAG<br>GTTCTAGCCCTTCTGCATCTACCGGTACTGGTCCAGGTGCATCCCCTGGTACCAGCTCTA<br>CCGGTTCTCCAGGTTCTAGCCCTTCTGCTTCTACCGGTACCGGTCCAGGTACCCCTGGCA<br>GCGGTACCGCATCTTCCTCTCAGGTAGCTCTACTCCGTCTGGTGCAACCGGTTCCCCAG<br>GTAGCTCTACTCCTTCTGGTGCTACTGGCTCCCCAGGTGCATCCCCTGGCACCAGCTCTA<br>CCGGTTCTCCA |
| AM923 | 198 | ATGGCTGAACCTGCTGGCTCTCCAACCTCCACTGAGGAAGGTGCATCCCCGGGCACCAG<br>CTCTACCGGTTCTCCAGGTAGCTCTACCCCGTCTGGTGCTACCGGCTCTCCAGGTAGCTC<br>TACCCCGTCTGGTGCTACTGGCTCTCCAGGTACTTCTACTGAACCGTCTGAAGGCAGCGC<br>ACCAGGTAGCGAACCGGCTACTTCCGGTTCTGAAACCCCAGGTAGCCCAGCAGGTTCTC<br>CAACTTCTACTGAAGAAGGTTCTACCAGCTCTACCGCAGAATCTCCTGGTCCAGGTACCT<br>CTACTCCGGAAAGCGGTCTGCATCTCCAGGTTCTACTAGCGAATCTCCTTCTGGCACTG<br>CACCAGGTTCTACTAGCGAATCCCCGTCTGGTACTGCTCCAGGTACTTCTACTCCTGAAA<br>GCGGTTCCGCTTCTCCAGGTACCTCTACTCCGGAAAGCGGTTCTGCATCTCCAGGTAGCG<br>AACCGGCAACCTCCGGCTCTGAAACCCCAGGTACCTCTGAAAGCGCTACTCCTGAATCC<br>GGCCCAGGTAGCCCGGCAGGTTCTCCGACTTCCACTGAGGAAGGTACCTCTACTGAACC<br>TTCTGAGGGCAGCGCTCCAGGTACTTCTGAAAGCGCTACCCCGGAGTCCGGTCCAGGTA<br>CTTCTACTGAACCGTCCGAAGGTAGCGCACCAGGTACTTCTACCGAACCGTCCGAGGGT<br>AGCGCACCAGGTAGCCCAGCAGGTTCTCCTACCTCCACCGAGGAAGGTACTTCTACCGA<br>ACCGTCCGAGGGTAGCGCACCAGGTACTTCTACCGAACCTTCCGAGGGCAGCGCACCAG<br>GTACTTCTGAAAGCGCTACCCCTGAGTCCGGCCCAGGTACTTCTGAAAGCGCTACTCCTG<br>AATCCGGTCCAGGTACCTCTACTGAACCTTCCGAAGGCAGCGCTCCAGGTACCTCTACC<br>GAACCGTCCGAGGGCAGCGCACCAGGTACTTCTGAAAGCGCAACCCCTGAATCCGGTCC<br>AGGTACTTCTACTGAACCTTCCGAAGGTAGCGCTCCAGGTAGCGAACCTGCTACTTCTGG<br>TTCTGAAACCCCAGGTAGCCCGGCTGGCTCTCCGACCTCCACCGAGGAAGGTAGCTCTA<br>CCCCGTCTGGTGCTACTGGTTCTCCAGGTACTCGGGCAGCGGTACTGCTTCTTCCTCTC<br>CAGGTAGCTCTACCCCTTCTGGTGCTACTGGCTCTCCAGGTACCTCTACCGAACCGTCCG<br>AGGGTAGCGCACCAGGTACCTCTACTGAACCGTCTGAGGGTAGCGCTCCAGGTAGCGAA<br>CCGGCAACCTCCGGTTCTGAAACTCCAGGTAGCCCTGCTGGCTCTCCGACTTCTACTGAG<br>GAAGGTAGCCCGGCTGGTTCTCCGACTTCTACTGAGGAAGGTACTTCTACCGAACCTTCC<br>GAAGGTAGCGCTCCAGGTGCAAGCGCAAGCGGCGCGCCAAGCACGGGAGGTACTTCTG<br>AAAGCGCTACTCCTGAGTCCGCCCAGGTAGCCCGGCTGGCTCTCCGACTTCCACCGAG<br>GAAGGTAGCCCGGCTGGCTCTCCAACTTCTACTGAAGAAGGTTCTACCAGCTCTACCGCT<br>GAATCTCCTGGCCCAGGTTCTACTAGCGAATCCCGTCTGGCACCGCACCAGGTACTTCC<br>CCTAGCGGTGAATCTTCTACTGCACCAGGTACCCCTGGCAGCGGTACCGCTTCTTCCTCT |

TABLE 7-continued

DNA sequences of XTEN and precursor sequences

| XTEN Name | SEQ ID NO: | DNA Nucleotide Sequence |
|---|---|---|
| | | CCAGGTAGCTCTACCCCGTCTGGTGCTACTGGCTCTCCAGGTTCTAGCCCGTCTGCATCT<br>ACCGGTACCGGCCCAGGTAGCGAACCGGCAACCTCCGGCTCTGAAACTCCAGGTACTTC<br>TGAAAGCGCTACTCCGGAATCCGGCCCAGGTAGCGAACCGGCTACTTCCGGCTCTGAAA<br>CCCCAGGTTCCACCAGCTCTACTGCAGAATCTCCGGGCCCAGGTTCTACTAGCTCTACTG<br>CAGAATCTCCGGGTCCAGGTACTTCTCCTAGCGGCGAATCTTCTACCGCTCCAGGTAGCG<br>AACCGGCAACCTCTGGCTCTGAAACTCCAGGTAGCGAACCTGCAACCTCCGGCTCTGAA<br>ACCCCAGGTACTTCTACTGAACCTTCTGAGGGCAGCGCACCAGGTTCTACCAGCTCTACC<br>GCAGAATCTCCTGGTCCAGGTACCTCTACTCCGGAAAGCGGCTCTGCATCTCCAGGTTCT<br>ACTAGCGAATCTCCTTCTGGCACTGCACCAGGTACTTCTACCGAACCGTCCGAAGGCAG<br>CGCTCCAGGTACCTCTACTGAACCTTCCGAGGGCAGCGCTCCAGGTACCTCTACCGAAC<br>CTTCTGAAGGTAGCGCACCAGGTAGCTCTACTCCGTCTGGTGCAACCGGCTCCCCAGGTT<br>CTAGCCCGTCTGCTTCCACTGGTACTGGCCCAGGTGCTTCCCCGGGCACCAGCTCTACTG<br>GTTCTCCAGGTAGCGAACCTGCTACCTCCGGTTCTGAAACCCCAGGTACCTCTGAAAGC<br>GCAACTCCGGAGTCTGGTCCAGGTAGCCCTGCAGGTTCTCCTACCTCCACTGAGGAAGG<br>TAGCTCTACTCCGTCTGGTGCAACCGGCTCCCCAGGTTCTAGCCCGTCTGCTTCCACTGG<br>TACTGGCCCAGGTGCTTCCCCGGGCACCAGCTCTACTGGTTCTCCAGGTACCTCTGAAAG<br>CGCTACTCCGGAGTCTGGCCCAGGTACCTCTACTGAACCGTCTGAGGGTAGCGCTCCAG<br>GTACTTCTACTGAACCGTCCGAAGGTAGCGCACCA |
| AE912 | 199 | ATGGCTGAACCTGCTGGCTCTCCAACCTCCACTGAGGAAGGTACCCCGGGTAGCGGTAC<br>TGCTTCTTCCTCTCCAGGTAGCTCTACCCCTTCTGGTGCAACCGGCTCTCCAGGTGCTTCT<br>CCGGGCACCAGCTCTACCGGTTCTCCAGGTAGCCCGGCTGGCTCTCCTACCTCTACTGAG<br>GAAGGTACTTCTGAAAGCGCTACTCCTGAGTCTGGTCCAGGTACCTCTACTGAACCGTCC<br>GAAGGTAGCGCTCCAGGTAGCCCAGCAGGCTCTCCGACTTCCACTGAGGAAGGTACTTC<br>TACTGAACCTTCCGAAGGCAGCGCACCAGGTACCTCTACTGAACCTTCTGAGGGCAGCG<br>CTCCAGGTACTTCTGAAAGCGCTACCCCGGAATCTGGCCCAGGTAGCGAACCGGCTACT<br>TCTGGTTCTGAAACCCCAGGTAGCGAACCGGCTACCTCCGGTTCTGAAACTCCAGGTAG<br>CCCGGCAGGCTCTCCGACCTCTACTGAGGAAGGTACTTCTGAAAGCGCAACCCCGGAGT<br>CCGGCCCAGGTACCTCTACCGAACCGTCTGAGGGCAGCGCACCAGGTACTTCTACCGAA<br>CCGTCCGAGGGTAGCGCACCAGGTAGCCCAGCAGGTTCTCCTACCTCCACCGAGGAAGG<br>TACTTCTACCGAACCGTCCGAGGGTAGCGCACCAGGTACCTCTACTGAACCTTCTGAGG<br>GCAGCGCTCCAGGTACTTCTGAAAGCGCTACCCCGGAGTCCGGTCCAGGTACTTCTACT<br>GAACCGTCCGAAGGTAGCGCACCAGGTACTTCTGAAAGCGCAACCCCTGAATCCGGTCC<br>AGGTAGCGAACCGGCTACTTCTGGCTCTGAGACTCCAGGTACTTCTACCGAACCGTCCG<br>AAGGTAGCGCACCAGGTACTTCTACTGAACCGTCTGAAGGTAGCGCACCAGGTACTTCT<br>GAAAGCGCAACCCCGGAATCCGGCCCAGGTACCTCTGAAAGCGCAACCCCGGAGTCCG<br>GCCCAGGTAGCCCTGCTGGCTCTCCAACCTCCACCGAAGAAGGTACCTCTGAAAGCGCA<br>ACCCCTGAATCCGGCCCAGGTAGCGAACCGGCAACCTCCGGTTCTGAAACCCCAGGTAC<br>CTCTGAAAGCGCTACTCCGGAGTCTGGCCCAGGTACCTCTACTGAACCGTCTGAGGGTA<br>GCGCTCCAGGTACTTCTACTGAACCGTCGAAGGTAGCGCACCAGGTACTTCTACCGAA<br>CCGTCCGAAGGCAGCGCTCCAGGTACCTCTACTGAACCTTCCGAGGGCAGCGCTCCAGG<br>TACCTCTACCGAACCTTCTGAAGGTAGCGCACCAGGTACTTCTACCGAACCGTCCGAGG<br>GTAGCGCACCAGGTAGCCCAGCAGGTTCTCCTACCTCCACCGAGGAAGGTACTTCTACC<br>GAACCGTCCGAGGGTAGCGCACCAGGTACTTCTGAAAGCGCAACTCCTGAGTCTGGCCC<br>AGGTAGCGAACCTGCTACCTCCGGCTCTGAGACTCCAGGTACCTCTGAAAGCGCAACCC<br>CGGAATCTGGTCCAGGTAGCGAACCTGCAACCTCTGGCTCTGAAACCCCAGGTACCTCT<br>GAAAGCGCTACTCCTGAATCTGGCCCAGGTACTTCTACTGAACCGTCCGAGGGCAGCGC<br>ACCAGGTACTTCTGAAAGCGCTACTCCTGAGTCCGGCCCAGGTAGCCCGGCTGGCTCTC<br>CGACTTCCACCGAGGAAGGTAGCCCGGCTGGCTCTCCAACTTCTACTGAAGAAGGTAGC<br>CCGGCAGGCTCTCCGACCTCTACTGAGGAAGGTACTTCTGAAAGCGCAACCCCGGAGTC<br>CGGCCCAGGTACCTCTACCGAACCGTCTGAGGGCAGCGCACCAGGTACCTCTGAAAGCG<br>CAACTCCGGAGTCTGGCCCAGGTAGCGAACCTGCTACCTCCGGCTCTGAGACTCCAGGT<br>ACCTCTGAAAGCGCAACCCCGGAATCTGGTCCAGGTAGCGAACCTGCAACCTCTGGCTC<br>TGAAACCCCAGGTACCTCTGAAAGCGCTACTCCTGAATCTGGCCCAGGTACTTCTACTGA<br>ACCGTCCGAGGGCAGCGCACCAGGTAGCCCTGCTGGCTCTCCAACCTCCACCGAAGAAG<br>GTACCTCTGAAAGCGCAACCCCTGAATCCGGCCCAGGTAGCGAACCGGCAACCTCCGGT<br>TCTGAAACCCCAGGTACTTCTGAAAGCGCTACTCCTGAGTCCGGCCCAGGTAGCCCGGC<br>TGGCTCTCCGACTTCCACCGAGGAAGGTAGCCCGGCTGGCTCTCCAACTTCTACTGAAG<br>AAGGTACTTCTACCGAACCTTCCGAGGGCAGCGCACCAGGTACTTCTGAAAGCGCTACC<br>CCTGAGTCCGGCCCAGGTACTTCTGAAAGCGCTACTCCTGAATCCGGTCCAGGTACTTCT<br>GAAAGCGCTACCCCGGAATCTGGCCCAGGTAGCGAACCGGCTACTTCTGGTTCTGAAAC<br>CCCAGGTAGCGAACCGGCTACCTCCGGTTCTGAAACTCCAGGTAGCCCAGCAGGCTCTC<br>CGACTTCCACTGAGGAAGGTACTTCTACTGAACCTTCCGAAGGCAGCGCACCAGGTACC<br>TCTACTGAACCTTCTGAGGGCAGCGCTCCAGGTAGCGAACCTGCAACCTCTGGCTCTGA<br>AACCCCAGGTACCTCTGAAAGCGCTACTCCTGAATCTGGCCCAGGTACTTCTACTGAACC<br>GTCCGAGGGCAGCGCACCA |
| AM1318 | 200 | GGTACTTCTACTGAACCGTCTGAAGGCAGCGCACCAGGTAGCGAACCGGCTACTTCCGG<br>TTCTGAAACCCCAGGTAGCCCAGCAGGTTCTCCAACTTCTACTGAAGAAGGTTCTACCA<br>GCTCTACCGCAGAATCTCCTGGTCCAGGTACCTCTACTCCGGAAAGCGGCTCTGCATCTC<br>CAGGTTCTACTAGCGAATCTCCTTCTGGCACTGCACCAGGTTCTACTAGCGAATCCCCGT<br>CTGGTACTGCTCCAGGTACTTCTACTCCTGAAAGCGGTTCCGCTTCTCCAGGTACCTCTA<br>CTCCGGAAAGCGGTTCTGCATCTCCAGGTAGCGAACCGGCAACCTCCGGCTCTGAAACC<br>CCAGGTACCTCTGAAAGCGCTACTCCTGAATCCGGCCCAGGTAGCCCGGCAGGTTCTCC |

TABLE 7-continued

DNA sequences of XTEN and precursor sequences

| XTEN Name | SEQ ID NO: | DNA Nucleotide Sequence |
|---|---|---|
| | | GACTTCCACTGAGGAAGGTACCTCTACTGAACCTTCTGAGGGCAGCGCTCCAGGTACTT |
| | | CTGAAAGCGCTACCCCGGAGTCCGGTCCAGGTACTTCTACTGAACCGTCCGAAGGTAGC |
| | | GCACCAGGTACTTCTACCGAACCGTCCGAGGGTAGCGCACCAGGTAGCCCAGCAGGTTC |
| | | TCCTACCTCCACCGAGGAAGGTACTTCTACCGAACCGTCCGAGGGTAGCGCACCAGGTA |
| | | CTTCTACCGAACCTTCCGAGGGCAGCGCACCAGGTACTTCTGAAAGCGCTACCCCTGAG |
| | | TCCGGCCCAGGTACTTCTGAAAGCGCTACTCCTGAATCCGGTCCAGGTACCTCTACTGAA |
| | | CCTTCCGAAGGCAGCGCTCCAGGTACCTCTACCGAACCGTCCGAGGGCAGCGCACCAGG |
| | | TACTTCTGAAAGCGCAACCCCTGAATCCGGTCCAGGTACTTCTACTGAACCTTCCGAAGG |
| | | TAGCGCTCCAGGTAGCGAACCTGCTACTTCTGGTTCTGAAACCCAGGTAGCCCGGCTG |
| | | GCTCTCCGACCTCCACCGAGGAAGGTAGCTCTACCCCGTCTGGTGCTACTGGTTCTCCAG |
| | | GTACTCCGGGCAGCGGTACTGCTTCTTCCTCTCCAGGTAGCTCTACCCCTTCTGGTGCTA |
| | | CTGGCTCTCCAGGTACCTCTACCGAACCGTCCGAGGGTAGCGCACCAGGTACCTCTACT |
| | | GAACCGTCTGAGGGTAGCGCTCCAGGTAGCGAACCGGCAACCTCCGGTTCTGAAACTCC |
| | | AGGTAGCCCTGCTGGCTCTCCGACTTCTACTGAGGAAGGTAGCCCGGCTGGTTCTCCGAC |
| | | TTCTACTGAGGAAGGTACTTCTACCGAACCTTCCGAAGGTAGCGCTCCAGGTCCAGAAC |
| | | CAACGGGGCCGGCCCCAAGCGGAGGTAGCGAACCGGCAACCTCCGGCTCTGAAACCCC |
| | | AGGTACCTCTGAAAGCGCTACTCCTGAATCCGGCCCAGGTAGCCCGGCAGGTTCTCCGA |
| | | CTTCCACTGAGGAAGGTACTTCTGAAAGCGCTACTCCTGAGTCCGGCCCAGGTAGCCCG |
| | | GCTGGCTCTCCGACTTCCACCGAGGAAGGTAGCCCGGCTGGCTCTCCAACTTCTACTGAA |
| | | GAAGGTACTTCTGAAAGCGCTACTCCTGAGTCCGGCCCAGGTAGCCCGGCTGGCTCTCC |
| | | GACTTCCACCGAGGAAGGTAGCCCGGCTGGCTCTCCAACTTCTACTGAAGAAGGTTCTA |
| | | CCAGCTCTACCGCTGAATCCTGGCCCAGGTTCTACTAGCGAATCTCCGTCTGGCACCG |
| | | CACCAGGTACTTCCCCTAGCGGTGAATCTTCTACTGCACCAGGTTCTACCAGCGAATCTC |
| | | CTTCTGGCACCGCTCCAGGTTCTACTAGCGAATCCCCGTCTGGTACCGCACCAGGTACTT |
| | | CTCCTAGCGGCGAATCTTCTACCGCACCAGGTACTTCTACCGAACCTTCCGAGGGCAGC |
| | | GCACCAGGTACTTCTGAAAGCGCTACCCCTGAGTCCGGCCCAGGTACTTCTGAAAGCGC |
| | | TACTCCTGAATCCGGTCCAGGTAGCGAACCGGCAACCTCTGGCTCTGAAACCCCAGGTA |
| | | CCTCTGAAAGCGCTACTCCGGAATCTGGTCCAGGTACTTCTGAAAGCGCTACTCCGGAA |
| | | TCCGGTCCAGGTACCTCTACTGAACCTTCTGAGGGCAGCGCTCCAGGTACTTCTGAAAGC |
| | | GCTACCCCGGAGTCCGGTCCAGGTACTTCTACTGAACCGTCCGAAGGTAGCGCACCAGG |
| | | TACCTCCCCTAGCGGCGAATCTTCTACTGCTCCAGGTACCTCTCCTAGCGGCGAATCTTC |
| | | TACCGCTCCAGGTACCTCCCCTAGCGGTGAATCTTCTACCGCACCAGGTACTTCTACCGA |
| | | ACCGTCCGAGGGTAGCGCACCAGGTAGCCCAGCAGGTTCTCCTACCTCCACCGAGGAAG |
| | | GTACTTCTACCGAACCGTCCGAGGGTAGCGCACCAGGTTCTAGCCCTTCTGCTTCCACCG |
| | | GTACCGGCCCAGGTAGCTCTACTCCGTCTGGTGCAACTGGCTCTCCAGGTAGCTCTACTC |
| | | CGTCTGGTGCAACCGGCTCCCCAGGTAGCTCTACCCCGTCTGGTGCTACCGGCTCTCCAG |
| | | GTAGCTCTACCCCGTCTGGTGCAACCGGCTCCCCAGGTGCATCCCCGGGTACTAGCTCTA |
| | | CCGGTTCTCAGGTGCAAGCGCAAGCGGCGCGCAAGCACGGGAGGTACTTCTCCGAGC |
| | | GGTGAATCTTCTACCGCACCAGGTTCTACTAGCTCTACCGCTGAATCTCCGGGCCCAGGT |
| | | ACTTCTCCGAGCGGTGAATCTTCTACTGCTCCAGGTACCTCTGAAAGCGCTACTCCGGAG |
| | | TCTGGCCCAGGTACCTCTACTGAACCGTCTGAGGGTAGCGCTCCAGGTACTTCTACTGAA |
| | | CCGTCCGAAGGTAGCGCACCAGGTTCTAGCCCTTCTGCATCTACTGGTACTGGCCCAGGT |
| | | AGCTCTACTCCTTCTGGTGCTACCGGCTCTCCAGGTGCTTCTCCGGGTACTAGCTCTACC |
| | | GGTTCTCCAGGTACTTCTACTCCGAAAGCGGTTCCGCATCTCCAGGTACTTCTCCTAGC |
| | | GGTGAATCTTCTACTGCTCCAGGTACCTCTCCTAGCGGCGAATCTTCTACTGCTCCAGGT |
| | | ACTTCTGAAAGCGCAACCCCTGAATCCGGTCCAGGTAGCGAACCGGCTACTTCTGGCTC |
| | | TGAGACTCCAGGTACTTCTACCGAACCGTCCGAAGGTAGCGCACCAGGTTCTACCAGCG |
| | | AATCCCCTTCTGGTACTGCTCCAGGTTCTACCAGCGAATCCCCTTCTGGCACCGCACCAG |
| | | GTACTTCTACCCCTGAAAGCGGCTCCGCTTCTCCAGGTAGCCCGGCAGGCTCTCCGACCT |
| | | CTACTGAGGAAGGTACTTCTGAAAGCGCAACCCCGGAGTCCGGCCCAGGTACCTCTACC |
| | | GAACCGTCTGAGGGCAGCGCACCAGGTAGCCCTGCTGGCTCTCCAACCTCCACCGAAGA |
| | | AGGTACCTCTGAAAGCGCAACCCCTGAATCCGGCCCAGGTAGCGAACCGGCAACCTCCG |
| | | GTTCTGAAACCCCAGGTAGCTCTACCCCGTCTGGTGCTACCGGTTCCCCAGGTGCTTCTC |
| | | CTGGTACTAGCTCTACCGGTTCTCCAGGTAGCTCTACCCCGTCTGGTGCTACTGGCTCTC |
| | | CAGGTTCTACTAGCGAATCCCCGTCTGGTACTGCTCCAGGTACTTCCCCTAGCGGTGAAT |
| | | CTTCTACTGCTCCAGGTTCTACCAGCTCTACCGCAGAATCTCCGGGTCCAGGTAGCTCTA |
| | | CCCCTTCTGGTGCAACCGGCTCTCCAGGTGCATCCCCGGGTACCAGCTCTACCGGTTCTC |
| | | CAGGTACTCCGGGTAGCGGTACCGCTTCTTCCTCTCAGGTAGCCCTGCTGGCTCTCCGA |
| | | CTTCTACTGAGGAAGGTAGCCCGGCTGGTTCTCCGACTTCTCCGACTTCTACTGAGGAAGGTACTTCTA |
| | | CCGAACCTTCCGAAGGTAGCGCTCCA |
| BC864 | 201 | GGTACTTCCACCGAACCATCCGAACCAGGTAGCGCAGGTACTTCCACCGAACCATCCGA |
| | | ACCTGGCAGCGCAGGTAGCGAACCGGCAACCTCTGGTACTGAACCATCAGGTAGCGGCG |
| | | CATCCGAGCCTACCTCTACTGAACCAGGTAGCGAACCGGCTACCTCCGGTACTGAGCCA |
| | | TCAGGTAGCGAACCGGCAACTTCCGGTACTGAACCATCAGGTAGCGAACCGGCAACTTC |
| | | CGGCACTGAACCATCAGGTAGCGGTGCATCTGAGCCGACCTCTACTGAACCAGGTACTT |
| | | CTACTGAACCATCTGAGCCGGGCAGCGCAGGTAGCGAACCAGCTACTTCTGGCACTGAA |
| | | CCATCAGGTACTTCTACTGAACCATCCGAACCAGGTAGCGCAGGTAGCGAACCTGCTAC |
| | | CTCTGGTACTGAGCCATCAGGTAGCGAACCGGCTACCTCTGGTACTGAACCATCAGGTA |
| | | CTTCTACCGAACCATCCGAGCCTGGTAGCGCAGGTACTTCTACCGAACCATCCGAGCCA |
| | | GGCAGCGCAGGTAGCGAACCGGCAACCTCTGGCACTGAGCCATCAGGTAGCGAACCAG |
| | | CAACTTCTGGTACTGAACCATCAGGTACTAGCGAGCCATCTACTTCCGAACCAGGTGCA |
| | | GGTAGCGGCGCATCCGAACCTACTTCCACTGAACCAGGTACTAGCGAGCCATCCACCTC |
| | | TGAACCAGGTGCAGGTAGCGAACCGGCAACTTCCGGCACTGAACCATCAGGTAGCGAA |

TABLE 7-continued

DNA sequences of XTEN and precursor sequences

| XTEN Name | SEQ ID NO: | DNA Nucleotide Sequence |
|---|---|---|
| | | CCGGCTACCTCTGGTACTGAACCATCAGGTACTTCTACCGAACCATCCGAGCCTGGTAGC
GCAGGTACTTCTACCGAACCATCCGAGCCAGGCAGCGCAGGTAGCGGTGCATCCGAGCC
GACCTCTACTGAACCAGGTAGCGAACCAGCAACTTCTGGCACTGAGCCATCAGGTAGCG
AACCAGCTACCTCTGGTACTGAACCATCAGGTAGCGAACCGGCTACTTCCGGCACTGAA
CCATCAGGTAGCGAACCAGCAACCTCCGGTACTGAACCATCAGGTACTTCCACTGAACC
ATCCGAACCGGGTAGCGCAGGTAGCGAACCGGCAACTTCCGGCACTGAACCATCAGGTA
GCGGTGCATCTGAGCCGACCTCTACTGAACCAGGTACTTCTACTGAACCATCTGAGCCG
GGCAGCGCAGGTAGCGAACCTGCAACCTCCGGCACTGAGCCATCAGGTAGCGGCGCATC
TGAACCAACCTCTACTGAACCAGGTACTTCCACCGAACCATCTGAGCCAGGCAGCGCAG
GTAGCGGCGCATCTGAACCAACCTCTACTGAACCAGGTAGCGAACCAGCAACTTCTGGT
ACTGAACCATCAGGTAGCGGCGCATCTGAGCCTACTTCCACTGAACCAGGTAGCGAACC
GGCAACTTCCGGCACTGAACCATCAGGTAGCGGTGCATCTGAGCCGACCTCTACTGAAC
CAGGTACTTCTACTGAACCATCTGAGCCGGGCAGCGCAGGTAGCGAACCGGCAACTTCC
GGCACTGAACCATCAGGTAGCGGTGCATCTGAGCCGACCTCTACTGAACCAGGTACTTC
TACTGAACCATCTGAGCCGGGCAGCGCAGGTAGCGAACCAGCTACTTCTGGCACTGAAC
CATCAGGTACTTCTACTGAACCATCCGAACCAGGTAGCGCAGGTAGCGAACCTGCTACC
TCTGGTACTGAGCCATCAGGTACTTCTACTGAACCATCCGAGCCGGGTAGCGCAGGTAC
TTCCACTGAACCATCTGAACCTGGTAGCGCAGGTACTTCTACTGAACCATCCGAACCAG
GTAGCGCAGGTACTTCTACTGAACCATCCGAGCCGGGTAGCGCAGGTACTTCCACTGAA
CCATCTGAACCTGGTAGCGCAGGTACTTCCACTGAACCATCCGAACCAGGTAGCGCAGG
TACTAGCGAACCATCCACCTCCGAACCAGGCGCAGGTAGCGGTGCATCTGAACCGACTT
CTACTGAACCAGGTACTTCCACTGAACCATCTGAGCCAGGTAGCGCAGGTACTTCCACC
GAACCATCCGAACCAGGTAGCGCAGGTACTTCCACCGAACCATCCGAACCTGGCAGCGC
AGGTAGCGAACCGGCAACCTCTGGTACTGAACCATCAGGTAGCGGTGCATCCGAGCCGA
CCTCTACTGAACCAGGTAGCGAACCAGCAACTTCTGGCACTGAGCCATCAGGTAGCGAA
CCAGCTACCTCTGGTACTGAACCATCAGGTAGCGAACCGGCAACCTCTGGCACTGAGCC
ATCAGGTAGCGAACCAGCAACTTCTGGTACTGAACCATCAGGTACTAGCGAGCCATCTA
CTTCCGAACCAGGTGCAGGTAGCGAACCTGCAACCTCCGGCACTGAGCCATCAGGTAGC
GGCGCATCTGAACCAACCTCTACTGAACCAGGTACTTCCACCGAACCATCTGAGCCAGG
CAGCGCAGGTAGCGAACCTGCAACCTCCGGCACTGAGCCATCAGGTAGCGGCGCATCTG
AACCAACCTCTACTGAACCAGGTACTTCCACCGAACCATCTGAGCCAGGCAGCGCA |
| BD864 | 202 | GGTAGCGAAACTGCTACTTCCGGCTCTGAGACTGCAGGTACTAGTGAATCCGCAACTAG
CGAATCTGGCGCAGGTAGCACTGCAGGCTCTGAGACTTCCACTGAAGCAGGTACTAGCG
AGTCCGCAACCAGCGAATCCGGCGCAGGTAGCGAAACTGCTACCTCTGGCTCCGAGACT
GCAGGTAGCGAAACTGCAACCTCTGGCTCTGAAACTGCAGGTACTTCCACTGAAGCAAG
TGAAGGCTCCGCATCAGGTACTTCCACCGAAGCAAGCGAAGGCTCCGCATCAGGTACTA
GTGAGTCCGCAACTAGCGAATCCGGTGCAGGTAGCGAAACCGCTACCTCTGGTTCCGAA
ACTGCAGGTACTTCTACCGAGGCTAGCGAAGGTTCTGCATCAGGTAGCACTGCTGGTTC
CGAGACTTCTACTGAAGCAGGTACTAGCGAATCTGCTACTAGCGAATCCGGCGCAGGTA
CTAGCGAATCCGCTACCAGCGAATCCGGCGCAGGTAGCGAAACTGCAACCTCTGGTTCC
GAGACTGCAGGTACTAGCGAGTCCGCTACTAGCGAATCTGGCGCAGGTACTTCCACTGA
AGCTAGTGAAGGTTCTGCATCAGGTAGCGAAACTGCTACTTCTGGTTCCGAAACTGCAG
GTAGCGAAACCGCTACCTCTGGTTCCGAAACTGCAGGTACTTCTACCGAGGCTAGCGAA
GGTTCTGCATCAGGTAGCACTGCTGGTTCCGAGACTTCTACTGAAGCAGGTACTAGCGA
GTCCGCTACTAGCGAATCTGGCGCAGGTACTTCCACTGAAGCTAGTGAAGGTTCTGCAT
CAGGTAGCGAAACTGCTACTTCTGGTTCCGAAACTGCAGGTAGCACTGCTGGCTCCGAG
ACTTCTACCGAAGCAGGTAGCACTGCAGGTTCCGAAACTTCCACTGAAGCAGGTAGCGA
AACTGCTACCTCTGGCTCTGAGACTGCAGGTACTGCTACTAGCGAATCCGCTACTAGCGAATCCG
GCGCAGGTACTAGCGAATCCGCTACCAGCGAATCCGGCGCAGGTAGCGAAACTGCAAC
CTCTGGTTCCGAGACTGCAGGTACTAGCGAATCTGCTACTAGCGAATCCGGCGCAGGTA
CTAGCGAATCCGCTACCAGCGAATCCGGCGCAGGTAGCGAAACTGCAACCTCTGGTTCC
GAGACTGCAGGTAGCGAAACCGCTACCTCTGGTTCCGAAACTGCAGGTACTTCTACCGA
GGCTAGCGAAGGTTCTGCATCAGGTAGCACTGCTGGTTCCGAGACTTCTACTGAAGCAG
GTAGCGAAACTGCTACTTCCGGCTCTGAGACTGCAGGTACTAGTGAATCCGCAACTAGC
GAATCTGGCGCAGGTAGCACTGCAGGCTCTGAGACTTCCACTGAAGCAGGTAGCACTGC
TGGTTCCGAAACCTCTACCGAAGCAGGTAGCACTGCAGGTTCTGAAACCTCCACTGAAG
CAGGTACTTCCACTGAGGCTAGTGAAGGCTCTGCATCAGGTAGCACTGCTGGTTCCGAA
ACCTCTACCGAAGCAGGTAGCACTGCAGGTTCTGAAACCTCCACTGAAGCAGGTACTTC
CACTGAGGCTAGTGAAGGCTCTGCATCAGGTAGCACTGCAGGTTCTGAGACTTCCACCG
AAGCAGGTAGCGAAACTGCTACTTCTGGTTCCGAAACTGCAGGTACTTCCACTGAAGCT
AGTGAAGGTTCGCATCAGGTACTAGTGAGTCCGCAACCAGCGAATCCGGCGCAGGTAG
CGAAACCGCAACCTCCGGTTCTGAAACTGCAGGTACTAGCGAATCCGCAACCAGCGAAT
CTGGCGCAGGTACTAGTGAGTCCGCAACCAGCGAATCCGGCAGGTAGCGAAACCGC
AACCTCCGGTTCTGAAACTGCAGGTACTAGCGAATCCGCAACCAGCGAATCTGGCGCAG
GTAGCGAAACTGCTACTTCCGGCTCTGAGACTGCAGGTACTTCCACCGAAGCAAGCGAA
GGTTCCGCATCAGGTACTTCCACCGAGGCTAGTGAAGGCTCTGCATCAGGTAGCACTGC
TGGCTCCGAGACTTCTACCGAAGCAGGTAGCACTGCAGGTTCCGAAACTTCCACTGAAG
CAGGTAGCGAAACTGCTACCTCTGGCTCTGAGACTGCAGGTACTAGCGAATCTGCTACT
AGCGAATCCGGCGCAGGTACTAGCGAATCCGCTACCAGCGAATCCGGCGCAGGTAGCG |

TABLE 7-continued

DNA sequences of XTEN and precursor sequences

| XTEN Name | SEQ ID NO: | DNA Nucleotide Sequence |
|---|---|---|
| | | AAACTGCAACCTCTGGTTCCGAGACTGCAGGTAGCGAAACTGCTACTTCCGGCTCCGAG<br>ACTGCAGGTAGCGAAACTGCTACTTCTGGCTCCGAAACTGCAGGTACTTCTACTGAGGC<br>TAGTGAAGGTTCCGCATCAGGTACTAGCGAGTCCGCAACCAGCGAATCCGGCGCAGGTA<br>GCGAAACTGCTACCTCTGGCTCCGAGACTGCAGGTAGCGAAACTGCAACCTCTGGCTCT<br>GAAACTGCAGGTACTAGCGAATCTGCTACTAGCGAATCCGGCGCAGGTACTAGCGAATC<br>CGCTACCAGCGAATCCGGCGCAGGTAGCGAAACTGCAACCTCTGGTTCCGAGACTGCA |

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferase, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have very repetitive amino acid sequences. Codon optimization is performed using computer programs (Gustafsson, C., et al. (2004) *Trends Biotechnol,* 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in *E. coli*). In the case of *E. coli*, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

Optionally, the full-length XTEN-encoding gene comprises one or more sequencing islands. In this context, sequencing islands are short-stretch sequences that are distinct from the XTEN library construct sequences and that include a restriction site not present or expected to be present in the full-length XTEN-encoding gene. In one embodiment, a sequencing island is the sequence 5'-AGGTGCAAGCG-CAAGCGGCGCGCCAAGCACGGGAGGT-3' (SEQ ID NO: 203). In another embodiment, a sequencing island is the sequence 5'-AGGTCCAGAACCAACGGGGCCGGC-CCCAAGCGGAGGT-3' (SEQ ID NO: 204).

In one embodiment, polynucleotide libraries are constructed using the disclosed methods wherein all members of the library encode the same amino acid sequence but the codon usage for the respective amino acids in the sequence is varied. Such libraries can be screened for highly expressing and genetically stable members that are particularly suitable for the large-scale production of XTEN-containing products.

Optionally, one can sequence clones in the library to eliminate isolates that contain undesirable sequences. The initial library of short XTEN sequences allows some variation in amino acid sequence. For instance one can randomize some codons such that a number of hydrophilic amino acids can occur in a particular position. During the process of iterative multimerization one can screen the resulting library members for other characteristics like solubility or protease resistance in addition to a screen for high-level expression.

Once the gene that encodes the XTEN of desired length and properties is selected, it is genetically fused at the desired location to the nucleotides encoding the aaT gene(s) by cloning it into the construct adjacent and in frame with the gene coding for aaT, or alternatively in frame with nucleotides encoding a spacer/cleavage sequence linked to a terminal XTEN. The invention provides various permutations of the foregoing, depending on the aaT-XTEN to be encoded. For example, a gene encoding an aaT-XTEN fusion protein comprising an aaT and two XTEN, such as embodied by formula III, as depicted above, the gene would have polynucleotides encoding aaT, and polynucleotides encoding two XTEN, which can be identical or different in composition and sequence length. In one non-limiting embodiment of the foregoing, the aaT polynucleotides would encode native aaT and the polynucleotides encoding the C-terminus XTEN would encode AE864 and the polynucleotides encoding an N-terminal XTEN AE912. The step of cloning the aaT genes into the XTEN construct can occur through a ligation or multimerization step, as shown in FIG. 10 in a schematic flowchart of representative steps in the assembly of an aat-XTEN polynucleotide construct. Individual oligonucleotides 501 are annealed into sequence motifs 502 such as a 12 amino acid motif ("12-mer"), which is ligated to additional sequence motifs from a library that can multimerize to create a pool that encompasses the desired length of the XTEN 504, as well as ligated to a smaller concentration of an oligo containing BbsI, and KpnI restriction sites 503. The motif libraries can be limited to specific sequence XTEN families; e.g., AD, AE, AF, AG, AM, or AQ sequences of Table 3. As illustrated in FIG. 10, the XTEN polynucleotides encode a length, in this case, of 36 amino acid residues, but longer lengths can be achieved by this process. For example, multimerization can be performed by ligation, overlap extension, PCR assembly or similar cloning techniques known in the art. The resulting pool of ligation products is gel-purified and the band with the desired length of XTEN is cut, resulting in an isolated XTEN gene with a stopper sequence 505. The XTEN gene can be cloned into a stuffer vector. In this case, the vector encodes an optional CBD sequence 506 and a GFP gene 508. Digestion is than performed with BbsI/HindIII to remove 507 and 508 and place the stop codon. The resulting product is then cloned into a BsaI/HindIII digested vector containing a gene encoding the aaT, resulting in the gene 500 encoding an aaT-XTEN fusion protein. As would be apparent to one of ordinary skill in the art, the methods can be applied to create constructs in alternative configurations and with varying XTEN lengths.

The constructs encoding aaT-XTEN fusion proteins can be designed in different configurations of the components XTEN, aaT, and spacer sequences, such as shown in FIG. 13. In one embodiment, the construct comprises polynucleotide sequences complementary to, or those that encode a monomeric polypeptide of components in the following order (5' to 3') aaT and XTEN. In another embodiment, the construct comprises polynucleotide sequences complementary to, or those that encode a monomeric polypeptide of components in the following order (5' to 3') XTEN and aaT. In another embodiment, the construct comprises polynucleotide sequences complementary to, or those that encode a monomeric polypeptide of components in the following order (5' to 3') XTEN, aaT, and a second XTEN. In another embodiment, the construct comprises polynucleotide sequences complementary to, or those that encode a monomeric polypeptide of components in the following order (5' to 3') aaT, spacer sequence, and XTEN. In another embodiment, the construct comprises polynucleotide sequences complementary to, or those that encode a monomeric polypeptide of components in the following order (5' to 3') XTEN, spacer sequence, and aaT. The spacer polynucleotides can optionally comprise sequences encoding cleavage sequences. As will be apparent to those of skill in the art, other permutations or multimers of the foregoing are possible.

The invention also encompasses polynucleotides comprising XTEN-encoding polynucleotide variants that have a high percentage of sequence identity compared to (a) a polynucleotide sequence from Table 7, or (b) sequences that are complementary to the polynucleotides of (a). A polynucleotide with a high percentage of sequence identity is one that has at least about an 80% nucleic acid sequence identity, alternatively at least about 81%, alternatively at least about 82%, alternatively at least about 83%, alternatively at least about 84%, alternatively at least about 85%, alternatively at least about 86%, alternatively at least about 87%, alternatively at least about 88%, alternatively at least about 89%, alternatively at least about 90%, alternatively at least about 91%, alternatively at least about 92%, alternatively at least about 93%, alternatively at least about 94%, alternatively at least about 95%, alternatively at least about 96%, alternatively at least about 97%, alternatively at least about 98%, and alternatively at least about 99% nucleic acid sequence identity compared to (a) or (b) of the foregoing, or that can hybridize with the target polynucleotide or its complement under stringent conditions.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology. 1970. 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the aaT-XTEN sequences under stringent conditions, such as those described herein.

Figure 14:
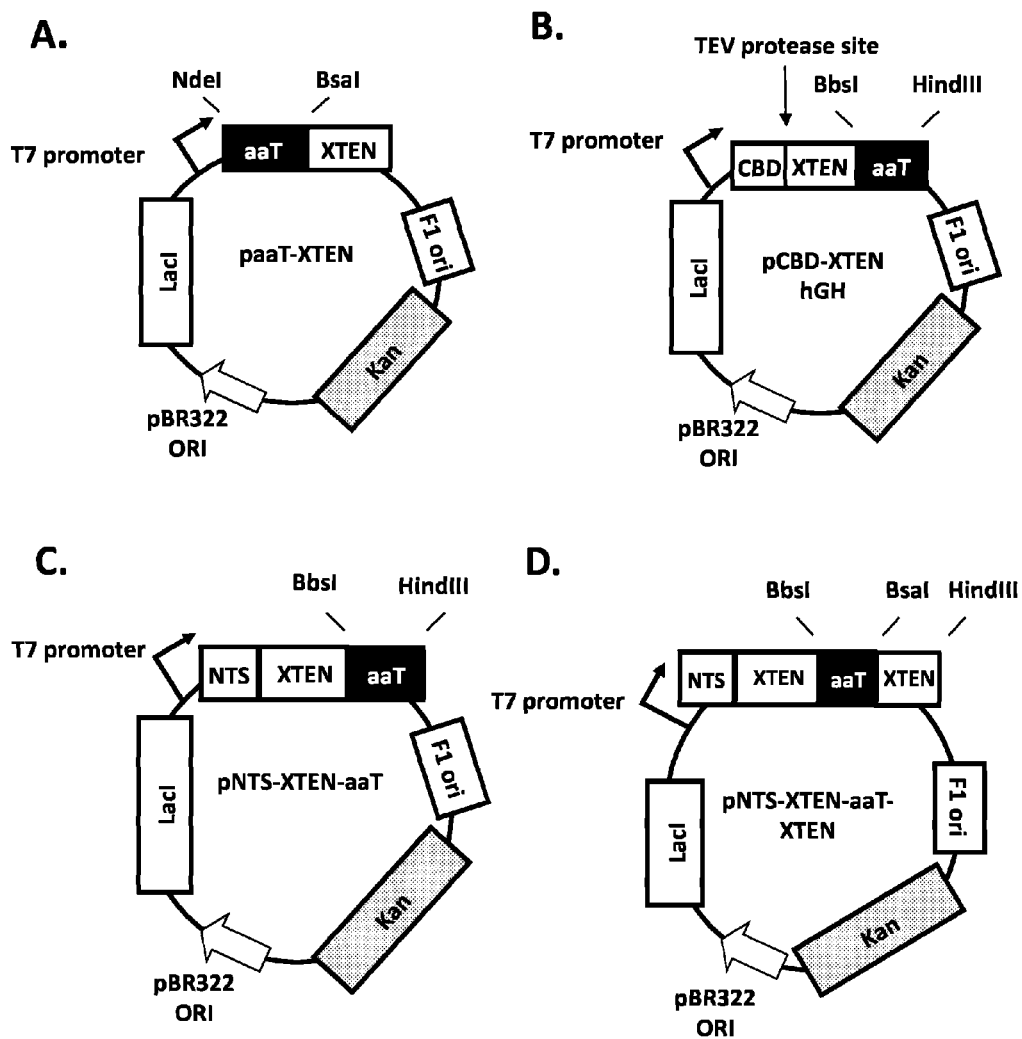
FIG. 14 is a schematic representation of the design of aaT-XTEN expression vectors with different processing strategies.

The resulting polynucleotides encoding the aaT-XTEN chimeric fusion proteins can then be individually cloned into an expression vector. The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence (FIG. 14). Construction of suitable vectors containing one or more of these components employs standard ligation techniques which are known to the skilled artisan. Such techniques are well known in the art and well described in the scientific and patent literature.

Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated.

The invention provides for the use of plasmid vectors containing replication and control sequences that are compatible with and recognized by the host cell, and are operably linked to the aaT-XTEN gene for controlled expression of the aaT-XTEN fusion proteins. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the fusion protein in a suitable host. The requirements are that the vectors are replicable and viable in the host cell of choice. Low- or high-copy number vectors may be used as desired.

Suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. Yeast expression systems that can also be used in the present invention include, but are not limited to, the non-fusion pYES2 vector (Invitrogen), the fusion pYESHisA, B, C (Invitrogen), pRS vectors and the like.

The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell.

Examples of suitable promoters for directing the transcription of the DNA encoding the aaT-XTEN in mammalian cells are the SV40 promoter (Subramani et al., Mol. Cell. Biol. 1 (1981), 854-864), the MT-1 (metallothionein gene) promoter (Palmiter et al., Science 222 (1983), 809-814), the CMV promoter (Boshart et al., Cell 41:521-530, 1985) or the adenovirus 2 major late promoter (Kaufman and Sharp, Mol. Cell. Biol, 2:1304-1319, 1982). The vector may also carry sequences such as UCOE (ubiquitous chromatin opening elements).

Examples of suitable promoters for use in filamentous fungus host cells are, for instance, the ADH3 promoter or the tpiA promoter. Examples of other useful promoters are those derived from the gene encoding A. oryzae TAKA amylase, Rhizomucor miehei aspartic proteinase, A. niger neutral α-amylase, A. niger acid stable α-amylase, A. niger or A. awamoriglucoamylase (gluA), Rhizomucor miehei lipase, A. oryzae alkaline protease, A. oryzae triose phosphate isomerase or A. nidulans acetamidase. Preferred are the TAKA-amylase and gluA promoters. Yeast expression systems that can also be used in the present invention include, but are not limited to, the non-fusion pYES2 vector (Invitrogen), the fusion pYESHisA, B, C (Invitrogen), pRS vectors and the like.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all is operably linked to the DNA encoding aaT-XTEN polypeptides. Promoters for use in bacterial systems can also contain a Shine-Dalgarno (S.D.) sequence, operably linked to the DNA encoding aaT-XTEN polypeptides.

The invention contemplates use of other expression systems including, for example, a baculovirus expression system with both non-fusion transfer vectors, such as, but not limited to pVL941 Summers, et al., Virology 84:390-402 (1978)), pVL1393 (Invitrogen), pVL1392 (Summers, et al., Virology 84:390-402 (1978) and Invitrogen) and pBlueBacIII (Invitrogen), and fusion transfer vectors such as, but not limited to, pAc700 (Summers, et al., Virology 84:390-402 (1978)), pAc701 and pAc70-2 (same as pAc700, with different reading frames), pAc360 Invitrogen) and pBlueBacHisA, B, C (Invitrogen) can be used.

The DNA sequences encoding the aaT-XTEN may also, if necessary, be operably connected to a suitable terminator, such as the hGH terminator (Palmiter et al., Science 222, 1983, pp. 809-814) or the TPII terminators (Alber and Kawasaki, J. Mol. Appl. Gen. 1, 1982, pp. 419-434) or ADH3 (McKnight et al., The EMBO J. 4, 1985, pp. 2093-2099). Expression vectors may also contain a set of RNA splice sites located downstream from the promoter and upstream from the insertion site for the aaT-XTEN sequence itself, including splice sites obtained from adenovirus. Also contained in the expression vectors is a polyadenylation signal located downstream of the insertion site. Particularly preferred polyadenylation signals include the early or late polyadenylation signal from SV40 (Kaufman and Sharp, ibid.), the polyadenylation signal from the adenovirus 5 Elb region, the hGH terminator (DeNoto et al. Nucl. Acids Res. 9:3719-3730, 1981). The expression vectors may also include a noncoding viral leader sequence, such as the adenovirus 2 tripartite leader, located between the promoter and the RNA splice sites; and enhancer sequences, such as the SV40 enhancer.

In one embodiment, the polynucleotide encoding an aaT-XTEN fusion protein composition is fused C-terminally to an N-terminal signal sequence appropriate for the expression host system. Signal sequences are typically proteolytically removed from the protein during the translocation and secretion process, generating a defined N-terminus. A wide variety of signal sequences have been described for most expression systems, including bacterial, yeast, insect, and mammalian systems. A non-limiting list of preferred examples for each expression system follows herein. Preferred signal sequences are OmpA, PhoA, and DsbA for E. coli expression. Signal peptides preferred for yeast expression are ppL-alpha, DEX4, invertase signal peptide, acid phosphatase signal peptide, CPY, or INU1. For insect cell expression the preferred signal sequences are sexta adipokinetic hormone precursor, CP1, CP2, CP3, CP4, TPA, PAP, or gp67. For mammalian expression the preferred signal sequences are IL2L, SV40, IgG kappa and IgG lambda.

In another embodiment, a leader sequence, potentially comprising a well-expressed, independent protein domain, can be fused to the N-terminus of the aaT-XTEN sequence, separated by a protease cleavage site. While any leader peptide sequence which does not inhibit cleavage at the designed proteolytic site can be used, sequences in preferred embodiments will comprise stable, well-expressed sequences such that expression and folding of the overall composition is not significantly adversely affected, and preferably expression, solubility, and/or folding efficiency are significantly improved. A wide variety of suitable leader sequences have been described in the literature. A non-limiting list of suitable sequences includes maltose binding protein, cellulose binding domain, glutathione S-transferase, 6×His tag (SEQ ID NO: 205), FLAG tag, hemaglutinin tag, and green fluorescent protein. The leader sequence can also be further improved by codon optimization, especially in the second codon position following the ATG start codon, by methods well described in the literature and hereinabove.

The procedures used to ligate the DNA sequences coding for the aaT-XTEN, the promoter and optionally the terminator and/or secretory signal sequence, respectively, and to insert them into suitable vectors containing the information necessary for replication, are well known to persons skilled in the art (cf., for instance, Sambrook, J. et al., "Molecular Cloning: A Laboratory Manual," 3$^{th}$ edition, Cold Spring Harbor Laboratory Press, 2001).

In other embodiments, the invention provides constructs and methods of making constructs comprising an polynucleotide sequence optimized for expression that encodes at least about 20 to about 60 amino acids with XTEN characteristics that can be included at the N-terminus of an XTEN carrier encoding sequence (in other words, the polynucleotides encoding the 20-60 encoded optimized amino acids are linked in frame to polynucleotides encoding an XTEN component that is N-terminal to aaT) to promote the initiation of translation to allow for expression of XTEN fusions at the N-terminus of proteins without the presence of a helper domain. In an advantage of the foregoing, the sequence does not require subsequent cleavage, thereby reducing the number of steps to manufacture XTEN-containing compositions. As described in more detail in the Examples, the optimized N-terminal sequence has attributes of an unstructured protein, but may include nucleotide bases encoding amino acids selected for their ability to promote initiation of translation and enhanced expression. In one embodiment of the foregoing, the optimized polynucleotide encodes an XTEN sequence with at least about 90% sequence identity compared to AE912. In another embodiment of the foregoing, the optimized polynucleotide encodes an XTEN sequence with at least about 90% sequence identity compared to AM923. In another embodiment of the foregoing, the optimized polynucleotide encodes an XTEN sequence with at least about 90% sequence identity compared to AE48. In another embodiment of the foregoing, the optimized polynucleotide encodes an XTEN sequence with at least about 90% sequence identity compared to AM48. In one embodiment, the optimized polynucleotide NTS comprises a sequence that exhibits at least about 80%, at least about 85%, at least about 90%, at least about 91%, at least about 92%, at least about 93%, at least about 94%, at least about 95%, at least about 96%, at least about 97%, at least about 98%, or at least about 99%, sequence identity compared to a sequence or its complement selected from AE 48: 5'-ATGGCTGAACCTGCTG-GCTCTCCAACCTCCACTGAGGAAGGTAC-CCCGGGTAGCGGTACTGCTTC TTCCTCTCCAGG-TAGCTCTACCCCTTCTGGTGCAACCGGCTCTCCAG-GTGCTTCTCCGGGCACCAG CTCTACCGGTTCTCCA-3' (SEQ ID NO: 206) and AM 48: 5'-ATGGCTGAACCT-GCTGGCTCTCCAACCTCCACTGAGGAAG-GTGCATCCCCGGGCACCAGCTCTAC CGGTTCTCCAGGTAGCTCTAC-CCCGTCTGGTGCTACCGGCTCTCCAGG-TAGCTCTACCCCGTCTGG TGCTACTGGCTCTCCA-3' (SEQ ID NO: 207).

In this manner, a chimeric DNA molecule coding for a monomeric aaT-XTEN fusion protein is generated. Optionally, this chimeric DNA molecule may be transferred or cloned into another construct that is a more appropriate expression vector. At this point, a host cell capable of expressing the chimeric DNA molecule can be transformed with the chimeric DNA molecule. The vectors containing the DNA segments of interest can be transferred into the host cell by well-known methods, depending on the type of cellular host. For example, calcium chloride transfection is commonly utilized for prokaryotic cells, whereas calcium phosphate treatment, lipofection, or electroporation may be used for other cellular hosts. Other methods used to transform mammalian cells include the use of polybrene, protoplast fusion, liposomes, electroporation, and microinjection. See, generally, Sambrook, et al., supra.

The transformation may occur with or without the utilization of a carrier, such as an expression vector. Then, the transformed host cell is cultured under conditions suitable for the expression of the chimeric DNA molecule encoding of aaT-XTEN.

The present invention also provides a host cell for expressing the monomeric fusion protein compositions disclosed herein. Examples of mammalian cell lines for use in the present invention are the COS-1 (ATCC CRL 1650), COS-7 (ATCC CRL 1651), BHK-21 (ATCC CCL 10)) and BHK-293 (ATCC CRL 1573; Graham et al., *J. Gen. Virol.* 36:59-72, 1977), BHK-570 cells (ATCC CRL 10314), CHO-K1 (ATCC CCL 61), CHO—S (Invitrogen 11619-012), and 293-F (Invitrogen R790-7). A tk-ts13 BHK cell line is also available from the ATCC under accession number CRL 1632. In addition, a number of other cell lines may be used within the present invention, including Rat Hep I (Rat hepatoma; ATCC CRL 1600), Rat Hep II (Rat hepatoma; ATCC CRL 1548), TCMK (ATCC CCL 139), Human lung (ATCC HB 8065), NCTC 1469 (ATCC CCL 9.1), CHO (ATCC CCL 61) and DUKX cells (Urlaub and Chasin, *Proc. Natl. Acad. Sci. USA* 77:4216-4220, 1980).

Examples of suitable yeasts host cells include cells of *Saccharomyces* spp. or *Schizosaccharomyces* spp., in particular strains of *Saccharomyces cerevisiae* or *Saccharomyces kluyveri*. Other yeasts include *Schizosaccharomyces pombe* (Beach and Nurse, Nature, 290: 140 [1981]; EP 139,383 published 2 May 1985); *Kluyveromyces* hosts (U.S. Pat. No. 4,943,529; Fleer et al., Bio/Technology, 9:968-975 (1991)) such as, e.g., K lactis (MW98-8C, CBS683, CBS4574; Louvencourt et al., J. Bacteriol., 737 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., Bio/Technology, 8:135 (1990)), *K. thermotolerans*, and *K. marxianus; yarrowia* (EP 402, 226); *Pichia pastoris* (EP 183,070; Sreekrishna et al., J. Basic Microbiol., 28:265-278 [1988]); *Candida; Trichoderma reesia* (EP 244,234); *Neurospora crassa* (Case et al., Proc. Natl. Acad. Sci. USA, 76:5259-5263 [1979]); *Schwanniomyces* such as *Schwanniomyces occidentalis* (EP 394,538 published 31 Oct. 1990). Methylotropic yeasts are suitable herein and include, but are not limited to, yeast capable of growth on methanol selected from the genera consisting of *Hansenula, Candida, Kloeckera, Pichia, Saccharomyces, Torulopsis,* and *Rhodotorula*. Further examples of suitable yeast cells are strains of *Kluyveromyces*, such as *Hansenula*, e.g. *H. polymorpha,* or *Pichia*, e.g. *P. pastoris* (cf. Gleeson et al., *J. Gen. Microbiol.* 132, 1986, pp. 3459-3465; U.S. Pat. No. 4,882, 279). A list of specific species that are exemplary of this class of yeasts may be found in C. Anthony, The Biochemistry of Methylotrophs, 269 (1982). Methods for transforming yeast cells with heterologous DNA and producing heterologous polypeptides there from are described, e.g. in U.S. Pat. No. 4,599,311, U.S. Pat. No. 4,931,373, U.S. Pat. Nos. 4,870,008, 5,037,743, and U.S. Pat. No. 4,845,075, all of which are hereby incorporated by reference.

Examples of other fungal cells are cells of filamentous fungi, e.g. *Aspergillus* spp., *Neurospora* spp., *Fusarium* spp. or *Trichoderma* spp., in particular strains of *A. oryzae, A. nidulans* or *A. niger*. The use of *Aspergillus* spp. for the expression of proteins is described in, e.g., EP 272 277, EP 238 023, EP 184 438 The transformation of *F. oxysporum* may, for instance, be carried out as described by Malardier et al., 1989, *Gene* 78: 147-156. The transformation of *Trichoderma* spp. may be performed for instance as described in EP 244 234.

Other suitable cells that can be used in the present invention include, but are not limited to, prokaryotic host cells strains such as *Escherichia coli*, (e.g., strain DH5-α), *Bacillus sub-*

*tilis, Salmonella typhimurium*, or strains of the genera of *Pseudomonas, Streptomyces* and *Staphylococcus*. Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma*; and *Vibrio*.

Transformed cells are selected by a phenotype determined by a selectable marker, commonly drug resistance or the ability to grow in the absence of a particular nutrient, e.g. leucine. A preferred vector for use in yeast is the POT1 vector disclosed in U.S. Pat. No. 4,931,373. The DNA sequences encoding the aaT-XTEN may be preceded by a signal sequence and optionally a leader sequence, e.g. as described above. Methods of transfecting mammalian cells and expressing DNA sequences introduced in the cells are described in e.g., Kaufman and Sharp, *J. Mol. Biol.* 159 (1982), 601-621; Southern and Berg, *J. Mol. Appl. Genet.* 1 (1982), 327-341; Loyter et al., *Proc. Natl. Acad. Sci. USA* 79 (1982), 422-426; Wigler et al., *Cell* 14 (1978), 725; Corsaro and Pearson, *Somatic Cell Genetics* 7 (1981), 603, Graham and van der Eb, *Virology* 52 (1973), 456; and Neumann et al., *EMBO J.* 1 (1982), 841-845.

Cloned DNA sequences are introduced into cultured mammalian cells by, for example, calcium phosphate-mediated transfection (Wigler et al., Cell 14:725-732, 1978; Corsaro and Pearson, Somatic Cell Genetics 7:603-616, 1981; Graham and Van der Eb, Virology 52d:456-467, 1973), transfection with many commercially available reagents such as FuGENEG Roche Diagnostics, Mannheim, Germany) or lipofectamine (Invitrogen) or by electroporation (Neumann et al., EMBO J. 1:841-845, 1982). To identify and select cells that express the exogenous DNA, a gene that confers a selectable phenotype (a selectable marker) is generally introduced into cells along with the gene or cDNA of interest. Preferred selectable markers include genes that confer resistance to drugs such as neomycin, hygromycin, puromycin, zeocin, and methotrexate. The selectable marker may be an amplifiable selectable marker. A preferred amplifiable selectable marker is a dihydrofolate reductase (DHFR) sequence. Further examples of selectable markers are well known to one of skill in the art and include reporters such as enhanced green fluorescent protein (EGFP), beta-galactosidase (β-gal) or chloramphenicol acetyltransferase (CAT). Selectable markers are reviewed by Thilly (Mammalian Cell Technology, Butterworth Publishers, Stoneham, Mass., incorporated herein by reference). A person skilled in the art will easily be able to choose suitable selectable markers. Any known selectable marker may be employed so long as it is capable of being expressed simultaneously with the nucleic acid encoding a gene product.

Selectable markers may be introduced into the cell on a separate plasmid at the same time as the gene of interest, or they may be introduced on the same plasmid. On the same plasmid, the selectable marker and the gene of interest may be under the control of different promoters or the same promoter, the latter arrangement produces a dicistronic message. Constructs of this type are known in the art (for example, Levinson and Simonsen, U.S. Pat. No. 4,713,339). It may also be advantageous to add additional DNA, known as "carrier DNA," to the mixture that is introduced into the cells.

After the cells have taken up the DNA, they are grown in an appropriate growth medium, typically 1-2 days, to begin expressing the gene of interest. As used herein the term "appropriate growth medium" means a medium containing nutrients and other components required for the growth of cells and the expression of the aaT-XTEN of interest. Media generally include a carbon source, a nitrogen source, essential amino acids, essential sugars, vitamins, salts, phospholipids, protein and growth factors. For production of gamma-carboxylated proteins, the medium will contain vitamin K, preferably at a concentration of about 0.1 µg/ml to about 5 µg/ml. Drug selection is then applied to select for the growth of cells that are expressing the selectable marker in a stable fashion. For cells that have been transfected with an amplifiable selectable marker the drug concentration may be increased to select for an increased copy number of the cloned sequences, thereby increasing expression levels. Clones of stably transfected cells are then screened for expression of the aaT polypeptide variant of interest.

The transformed or transfected host cell is then cultured in a suitable nutrient medium under conditions permitting expression of the aaT-XTEN fusion protein after which the resulting peptide may be recovered from the culture. The medium used to culture the cells may be any conventional medium suitable for growing the host cells, such as minimal or complex media containing appropriate supplements. Suitable media are available from commercial suppliers or may be prepared according to published recipes (e.g. in catalogues of the American Type Culture Collection). The culture conditions, such as temperature, pH and the like, are those previously used with the host cell selected for expression, and will be apparent to the ordinarily skilled artisan.

Gene expression may be measured in a sample directly, for example, by conventional Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence aaT polypeptide or against a synthetic peptide based on the DNA sequences provided herein or against exogenous sequence fused to aaT and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

Expressed aaT-XTEN polypeptide product(s) may be purified via methods known in the art or by methods disclosed herein. Procedures such as gel filtration, affinity purification (e.g., using an anti-aaT antibody column), salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Additional purification may be achieved by conventional chemical purification means, such as high performance liquid chromatography.

Some expressed aaT-XTEN may require refolding during isolation and purification. Methods of purification are described in Robert K. Scopes, Protein Purification: Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994). For therapeutic purposes it is preferred that the aaT-XTEN fusion proteins of the invention are substantially pure. Thus, in a preferred embodiment of the invention the aaT-XTEN of the invention is purified to at least about 90 to 95% homogeneity, preferably to at least about 98% homogeneity. Purity may be assessed by, e.g., gel electrophoresis, HPLC, and amino-terminal amino acid sequencing.

VIII). Pharmaceutical Compositions

The present invention provides pharmaceutical compositions comprising aaT-XTEN. In one embodiment, the pharmaceutical composition comprises an aaT-XTEN fusion protein disclosed herein and at least one pharmaceutically acceptable carrier. aaT-XTEN polypeptides of the present invention can be formulated according to known methods to prepare pharmaceutically useful compositions, whereby the polypeptide is combined in admixture with a pharmaceutically acceptable carrier vehicle, such as aqueous solutions, buffers, solvents and/or pharmaceutically acceptable suspensions, emulsions, stabilizers or excipients. Examples of non-aqueous solvents include propylethylene glycol, polyethylene glycol and vegetable oils. Formulations of the pharmaceutical compositions are prepared for storage by mixing the active aaT-XTEN ingredient having the desired degree of purity with optional physiologically acceptable carriers, excipients (e.g., sodium chloride, a calcium salt, sucrose, or polysorbate) or stabilizers (e.g., sucrose, trehalose, raffinose, arginine, a calcium salt, glycine or histidine), as described in Remington's Pharmaceutical Sciences 16th edition, Osol, A. Ed. (1980), in the form of lyophilized formulations or aqueous solutions.

In one embodiment, the pharmaceutical composition may be supplied as a lyophilized powder to be reconstituted prior to administration. In another embodiment, the pharmaceutical composition may be supplied in a liquid form, which can be administered directly to a patient. In another embodiment, the composition is supplied as a liquid in a pre-filled syringe for administration of the composition. In another embodiment, the composition is supplied as a liquid in a pre-filled vial that can be incorporated into a pump.

The pharmaceutical compositions can be administered by any suitable means or route, including subcutaneously, subcutaneously by infusion pump, intramuscularly, intravenously, or via the pulmonary route. It will be appreciated that the preferred route will vary with the disease and age of the recipient, and the severity of the condition being treated.

In one embodiment, the aaT-XTEN pharmaceutical composition in liquid form or after reconstitution (when supplied as a lyophilized powder) comprises alpha 1-antitrypsin linked to XTEN, which composition is capable of increasing alpha 1-antitrypsin activity to at least 10% of the normal plasma level in the blood for at least about 72 hours, or at least about 96 hours, or at least about 120 hours, or at least about 7 days, or at least about 10 days, or at least about 14 days, or at least about 21 days after administration of the alpha 1-antitrypsin pharmaceutical composition to a subject in need. In another embodiment, the aaT-XTEN pharmaceutical composition in liquid form or after reconstitution (when supplied as a lyophilized powder) is capable of increasing alpha 1-antitrypsin activity to at least 8, $\mu$M, or at least about 9 $\mu$M, or at least about 10 $\mu$M, or at least about 11 $\mu$M, or at least about 12 $\mu$M, or at least about 13 $\mu$M, or at least about 14 $\mu$M, or at least about 16 $\mu$M, or at least about 18 $\mu$M, or at least about 20 $\mu$M, or at least about 25 $\mu$M in the blood for at least about 72 hours, or at least about 96 hours, or at least about 120 hours, or at least about 7 days, or at least about 10 days, or at least about 14 days, or at least about 21 days after administration of the alpha 1-antitrypsin pharmaceutical composition to a subject in need. In another embodiment, the aaT-XTEN pharmaceutical composition in liquid form or after reconstitution (when supplied as a lyophilized powder) is capable of being aerosolized and administered via inhalation to the lungs, increasing and maintaining localized alpha 1-antitrypsin activity such that intact aaT-XTEN is capable of being detected in pulmonary fluids for at least about 72 hours, or at least about 96 hours, or at least about 120 hours, or at least about 7 days after administration of the alpha 1-antitrypsin pharmaceutical composition to a subject in need. It is specifically contemplated that the pharmaceutical compositions of the foregoing embodiments in this paragraph can be formulated to include one or more excipients, buffers or other ingredients known in the art to be compatible with administration by the intravenous route or the subcutaneous route or the intramuscular route or the pulmonary route. Thus, in the embodiments hereinabove described in this paragraph, the pharmaceutical composition is administered subcutaneously, intramuscularly, intravenously, or via the pulmonary route.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

In another embodiment, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (nonpolar) tails of the lipid are oriented toward the center of the bilayer while the hydrophilic (polar) heads orient towards the aqueous phase. In one embodiment, the liposome may be coated with a flexible water soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126, 966; 6,056,973; 6,043,094, the contents of which are incorporated by reference in their entirety.

Liposomes may be comprised of any lipid or lipid combination known in the art. For example, the vesicle-forming lipids may be naturally-occurring or synthetic lipids, including phospholipids, such as phosphatidylcholine, phosphatidylethanolamine, phosphatidic acid, phosphatidylserine, phasphatidylglycerol, phosphatidylinositol, and sphingomyelin as disclosed in U.S. Pat. Nos. 6,056,973 and 5,874,104. The vesicle-forming lipids may also be glycolipids, cerebrosides, or cationic lipids, such as 1,2-dioleyloxy-3-(trimethylamino) propane (DOTAP); N-[1-(2,3,-ditetradecyloxy)propyl]-N,N-dimethyl-N-hydroxyethylammonium bromide (DMRIE); N-[1[(2,3,-dioleyloxy)propyl]-N,N-dimethyl-N-hydroxy ethylammonium bromide (DORIE); N-[1-(2,3-dioleyloxy)propyl]-N,N, N-trimethylammonium chloride (DOTMA); 3 [N—(N',N'-dimethylaminoethane) carbamoyl] cholesterol (DC-Chol); or dimethyldioctadecylammonium (DDAB) also as disclosed in U.S. Pat. No. 6,056,973. Cholesterol may also be present in the proper range to impart stability to the vesicle as disclosed in U.S. Pat. Nos. 5,916,588 and 5,874,104.

Additional liposomal technologies are described in U.S. Pat. Nos. 6,759,057; 6,406,713; 6,352,716; 6,316,024; 6,294, 191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention.

For liquid formulations, a desired property is that the formulation be supplied in a form that can pass through a 25, 28, 30, 31, 32 gauge needle for intravenous, intramuscular, intraarticular, or subcutaneous administration. In another embodiment, a desired property is that the formulation be supplied in a form that can be nebulized into an aerosol of suitable particle size for inhalation therapy.

Osmotic pumps may be used as slow release agents in the form of tablets, pills, capsules or implantable devices. Osmotic pumps are well known in the art and readily available to one of ordinary skill in the art from companies experienced in providing osmotic pumps for extended release drug delivery. Examples are ALZA's DUROS™; ALZA's OROS™; Osmotica Pharmaceutical's Osmodex™ system; Shire Laboratories' EnSoTrol™ system; and Alzet™. Patents that describe osmotic pump technology are U.S. Pat. Nos. 6,890,918; 6,838,093; 6,814,979; 6,713,086; 6,534,090; 6,514,532; 6,361,796; 6,352,721; 6,294,201; 6,284,276; 6,110,498; 5,573,776; 4,200,0984; and 4,088,864, the contents of which are incorporated herein by reference. One skilled in the art, considering both the disclosure of this invention and the disclosures of these other patents could produce an osmotic pump for the extended release of the polypeptides of the present invention.

Syringe pumps may also be used as slow release agents. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

IX). Pharmaceutical Kits

In another aspect, the invention provides a kit to facilitate the use of the aaT-XTEN polypeptides. The kit comprises the pharmaceutical composition provided herein, a label identifying the pharmaceutical composition, and an instruction for storage, reconstitution and/or administration of the pharmaceutical compositions to a subject. In some embodiment, the kit comprises, preferably: (a) an amount of an aaT-XTEN fusion protein composition sufficient to treat a disease, condition or disorder upon administration to a subject in need thereof; and (b) an amount of a pharmaceutically acceptable carrier; together in a formulation ready for injection or for reconstitution with sterile water, buffer, or dextrose; together with a label identifying the aaT-XTEN drug and storage and handling conditions, and a sheet of the approved indications for the drug, instructions for the reconstitution and/or administration of the aaT-XTEN drug for the use for the prevention and/or treatment of an approved indication, appropriate dosage and safety information, and information identifying the lot and expiration of the drug. In another embodiment of the foregoing, the kit can comprise a second container that can carry a suitable diluent for the aaT-XTEN composition, the use of which will provide the user with the appropriate concentration of aaT-XTEN to be delivered to the subject.

EXAMPLES

Example 1

Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence $[\alpha]_3$ where X is a 12mer peptide with the sequences: GESPGGSSGSES (SEQ ID NO: 208), GSEGSSGPGESS (SEQ ID NO: 209), GSSESGSSEGGP (SEQ ID NO: 210), or GSGGEPSESGSS (SEQ ID NO: 211). The insert was obtained by annealing the following pairs of phosphorylated synthetic oligonucleotide pairs:

```
AD1for:
                                    (SEQ ID NO: 212)
AGGTGAATCTCCDGGTGGYTCYAGCGGTTCYGARTC AD1rev:
                                    (SEQ ID NO: 213)
ACCTGAYTCRGAACCGCTRGARCCACCHGGAGATTC
```

-continued

AD2for:
                        (SEQ ID NO: 214)
AGGTAGCGAAGGTTCTTCYGGTCCDGGYGARTCYTC AD2rev:
                        (SEQ ID NO: 215)
ACCTGARGAYTCRCCHGGACCRGAAGAACCTTCGCT AD3for:
                        (SEQ ID NO: 216)
AGGTTCYTCYGAAAGCGGTTCTTCYGARGGYGGTCC AD3rev:
                        (SEQ ID NO: 217)
ACCTGGACCRCCYTCRGAAGAACCGCTTTCRGARGA AD4for:
                        (SEQ ID NO: 218)
AGGTTCYGGTGGYGAACCDTCYGARTCTGGTAGCTC We also annealed the phosphorylated oligonucleotide 3KpnIstopperFor: AGGTTCGTCTTCACTCGAGGGTAC (SEQ ID NO: 219) and the non-phosphorylated oligonucleotide pr_3 KpnIstopperRev: CCTCGAGTGAAGACGA (SEQ ID NO: 220). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs for these segments are listed in Table 8.

TABLE 8

DNA and Amino Acid Sequences for 36-mer motifs

| File name | Amino acid sequence | SEQ ID NO: | Nucleotide sequence | SEQ ID NO: |
| --- | --- | --- | --- | --- |
| LCW0401_001_GFP-N_A01.ab1 | GSGGEPSESGSSGESPGG SSGSESGESPGGSSGSES | 221 | GGTTCTGGTGGCGAACCGTCCGAGTCTGGTA GCTCAGGTGAATCTCCGGGTGGCTCTAGCGG TTCCGAGTCAGGTGAATCTCCTGGTGGTTCC AGCGGTTCCGAGTCA | 222 |
| LCW0401_002_GFP-N_B01.ab1 | GSEGSSGPGESSGESPGG SSGSESGSSESGSSEGGP | 223 | GGTAGCGAAGGTTCTTCTGGTCCTGGCGAGT CTTCAGGTGAATCTCCTGGTGGTTCCAGCGG TTCTGAATCAGGTTCCTCCGAAAGCGGTTCT TCCGAGGGCGGTCCA | 224 |
| LCW0401_003_GFP-N_C01.ab1 | GSSESGSSEGGPGSSESG SSEGGPGESPGGSSGSES | 225 | GGTTCCTCTGAAAGCGGTTCTTCCGAAGGTG GTCCAGGTTCCTCTGAAAGCGGTTCTTCTGA GGGTGGTCCAGGTGAATCTCCGGGTGGCTCC AGCGGTTCCGAGTCA | 226 |
| LCW0401_004_GFP-N_D01.ab1 | GSGGEPSESGSSGSSESG SSEGGPGSGGEPSESGSS | 227 | GGTTCCGGTGGCGAACCGTCTGAATCTGGTA GCTCAGGTTCTTCTGAAAGCGGTTCTTCCGA GGGTGGTCCAGGTTCTGGTGGTGAACCTTCC GAGTCTGGTAGCTCA | 228 |
| LCW0401_007_GFP-N_F01.ab1 | GSSESGSSEGGPGSEGSS GPGESSGSEGSSGPGESS | 229 | GGTTCTTCCGAAAGCGGTTCTTCTGAGGGTG GTCCAGGTAGCGAAGGTTCTTCCGGTCCAGG TGAGTCTTCAGGTAGCGAAGGTTCTTCTGGT CCTGGTGAATCTTCA | 230 |
| LCW0401_008_GFP-N_G01.ab1 | GSSESGSSEGGPGSEGPGG SSGSESGSEGSSGPGESS | 231 | GGTTCCTCTGAAAGCGGTTCTTCCGAGGGTG GTCCAGGTGAATCTCCAGGTGGTTCCAGCGG TTCTGAGTCAGGTAGCGAAGGTTCTTCTGGT CCAGGTGAATCCTCA | 232 |
| LCW0401_012_GFP-N_H01.ab1 | GSGGEPSESGSSGSSGGEP SESGSSGSEGSSGPGESS | 233 | GGTTCTGGTGGTGAACCGTCTGAGTCTGGTA GCTCAGGTTCCGGTGGCGAACCATCCGAATC TGGTAGCTCAGGTAGCGAAGGTTCTTCCGGT CCAGGTGAGTCTTCA | 234 |
| LCW0401_015_GFP-N_A02.ab1 | GSSESGSSEGGPGSEGSS GPGESSGESPGGSSGSES | 235 | GGTTCTTCCGAAAGCGGTTCTTCCGAAGGCG GTCCAGGTAGCGAAGGTTCTTCTGGTCCAGG CGAATCTTCAGGTGAATCTCCTGGTGGCTCC AGCGGTTCTGAGTCA | 236 |
| LCW0401_016_GFP-N_B02.ab1 | GSSESGSSEGGPGSSESG SSEGGPGSSESGSSEGGP | 237 | GGTTCCTCCGAAAGCGGTTCTTCTGAGGGCG GTCCAGGTTCCTCCGAAAGCGGTTCTTCCGA GGGCGGTCCAGGTTCTTCTGAAAGCGGTTCT TCCGAGGGCGGTCCA | 238 |

TABLE 8-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_020_GFP-N_E02.ab1 | GSGGEPSESGSSGSEGSS GPGESSGSSESGSSEGGP | 239 | GGTTCCGGTGGCGAACCGTCCGAATCTGGTA GCTCAGGTAGCGAAGGTTCTTCTGGTCCAGG CGAATCTTCAGGTTCCTCTGAAAGCGGTTCT TCTGAGGGCGGTCCA | 240 |
| LCW0401_022_GFP-N_F02.ab1 | GSGGEPSESGSSGSSESG SSEGGPGSGGEPSESGSS | 241 | GGTTCTGGTGGTGAACCGTCCGAATCTGGTA GCTCAGGTTCTTCCGAAAGCGGTTCTTCTGA AGGTGGTCCAGGTTCCGGTGGCGAACCTTCT GAATCTGGTAGCTCA | 242 |
| LCW0401_024_GFP-N_G02.ab1 | GSGGEPSESGSSGSSESG SSEGGPGESPGGSSGSES | 243 | GGTTCTGGTGGCGAACCGTCCGAATCTGGTA GCTCAGGTTCCTCCGAAAGCGGTTCTTCTGA AGGTGGTCCAGGTGAATCTCCAGGTGGTTCT AGCGGTTCTGAATCA | 244 |
| LCW0401_026_GFP-N_H02.ab1 | GSGGEPSESGSSGESPGG SSGSESGSEGSSGPGESS | 245 | GGTTCTGGTGGCGAACCGTCTGAGTCTGGTA GCTCAGGTGAATCTCCTGGTGGCTCCAGCGG TTCTGAATCAGGTAGCGAAGGTTCTTCTGGT CCTGGTGAATCTTCA | 246 |
| LCW0401_027_GFP-N_A03.ab1 | GSGGEPSESGSSGESPGG SSGSESGSGGEPSESGSS | 247 | GGTTCCGGTGGCGAACCTTCCGAATCTGGTA GCTCAGGTGAATCTCCGGGTGGTTCTAGCGG TTCTGAGTCAGGTTCTGGTGGTGAACCTTCC GAGTCTGGTAGCTCA | 248 |
| LCW0401_028_GFP-N_B03.ab1 | GSSESGSSEGGPGSSESG SSEGGPGSSESGSSEGGP | 249 | GGTTCCTCTGAAAGCGGTTCTTCTGAGGGCG GTCCAGGTTCTTCCGAAAGCGGTTCTTCCGA GGGCGGTCCAGGTTCTTCCGAAAGCGGTTCT TCTGAAGGCGGTCCA | 250 |
| LCW0401_030_GFP-N_C03.ab1 | GESPGGSSGSESGSEGSS GPGESSGSEGSSGPGESS | 251 | GGTGAATCTCCGGGTGGCTCCAGCGGTTCTG AGTCAGGTAGCGAAGGTTCTTCCGGTCCGGG TGAGTCCTCAGGTAGCGAAGGTTCTTCCGGT CCTGGTGAGTCTTCA | 252 |
| LCW0401_031_GFP-N_D03.ab1 | GSGGEPSESGSSGSGGEP SESGSSGSSESGSSEGGP | 253 | GGTTCTGGTGGCGAACCTTCCGAATCTGGTA GCTCAGGTTCCGGTGGTGAACCTTCTGAATC TGGTAGCTCAGGTTCTTCTGAAAGCGGTTCT TCCGAGGGCGGTCCA | 254 |
| LCW0401_033_GFP-N_E03.ab1 | GSGGEPSESGSSGSGGEP SESGSSGSGGEPSESGSS | 255 | GGTTCCGGTGGTGAACCTTCTGAATCTGGTA GCTCAGGTTCCGGTGGCGAACCATCCGAGTC TGGTAGCTCAGGTTCCGGTGGTGAACCATCC GAGTCTGGTAGCTCA | 256 |
| LCW0401_037_GFP-N_F03.ab1 | GSGGEPSESGSSGSSESG SSEGGPGSEGSSGPGESS | 257 | GGTTCCGGTGGCGAACCTTCTGAATCTGGTA GCTCAGGTTCCTCCGAAAGCGGTTCTTCTGA GGGCGGTCCAGGTAGCGAAGGTTCTTCTGGT CCGGGCGAGTCTTCA | 258 |
| LCW0401_038_GFP-N_G03.ab1 | GSGGEPSESGSSGSSEGSS GPGESSGSGGEPSESGSS | 259 | GGTTCCGGTGGTGAACCGTCCGAGTCTGGTA GCTCAGGTAGCGAAGGTTCTTCTGGTCCGGG TGAGTCTTCAGGTTCTGGTGGCGAACCGTCC GAATCTGGTAGCTCA | 260 |
| LCW0401_039_GFP-N_H03.ab1 | GSGGEPSESGSSGESPGG SSGSESGSGGEPSESGSS | 261 | GGTTCTGGTGGCGAACCGTCCGAATCTGGTA GCTCAGGTGAATCTCCTGGTGGTTCCAGCGG TTCCGAGTCAGGTTCTGGTGGCGAACCTTCC GAATCTGGTAGCTCA | 262 |
| LCW0401_040_GFP-N_A04.ab1 | GSSESGSSEGGPGSGGEP SESGSSGSSESGSSEGGP | 263 | GGTTCTTCCGAAAGCGGTTCTTCCGAGGGCG GTCCAGGTTCCGGTGGTGAACCATCTGAATC TGGTAGCTCAGGTTCTTCTGAAAGCGGTTCT TCTGAAGGTGGTCCA | 264 |
| LCW0401_042_GFP-N_C04.ab1 | GSEGSSGPGESSGESPGG SSGSESGSEGSSGPGESS | 265 | GGTAGCGAAGGTTCTTCCGGTCCTGGTGAGT CTTCAGGTGAATCTCCAGGTGGCTCTAGCGG TTCCGAGTCAGGTAGCGAAGGTTCTTCTGGT CCTGGCGAGTCCTCA | 266 |
| LCW0401_046_GFP-N_D04.ab1 | GSSESGSSEGGPGSSESG SSEGGPGSSESGSSEGGP | 267 | GGTTCCTCTGAAAGCGGTTCTTCCGAAGGCG GTCCAGGTTCTTCCGAAAGCGGTTCTTCTGA GGGCGGTCCAGGTTCCTCCGAAAGCGGTTCT TCTGAGGGTGGTCCA | 268 |

TABLE 8-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_047_GFP-N_E04.ab1 | GSGGEPSESGSSGESPGGSSGSESGESPGGSSGSES | 269 | GGTTCTGGTGGCGAACCTTCCGAGTCTGGTAGCTCAGGTGAATCTCCGGGTGGTTCTAGCGGTTCCGAGTCAGGTGAATCTCCGGGTGGTTCCAGCGGTTCTGAGTCA | 270 |
| LCW0401_051_GFP-N_F04.ab1 | GSGGEPSESGSSGSEGSSGPGESSGESPGGSSGSES | 271 | GGTTCTGGTGGCGAACCATCTGAGTCTGGTAGCTCAGGTAGCGAAGGTTCTTCCGGTCCAGGCGAGTCTTCAGGTGAATCTCCTGGTGGCTCCAGCGGTTCTGAGTCA | 272 |
| LCW0401_053_GFP-N_H04.ab1 | GESPGGSSGSESGESPGGSSGSESGESPGGSSGSES | 273 | GGTGAATCTCCTGGTGGTTCCAGCGGTTCCGAGTCAGGTGAATCTCCAGGTGGCTCTAGCGGTTCCGAGTCAGGTGAATCTCCTGGTGGTTCTAGCGGTTCTGAATCA | 274 |
| LCW0401_054_GFP-N_A05.ab1 | GSEGSSGPGESSGSEGSSGPGESSGSGGEPSESGSS | 275 | GGTAGCGAAGGTTCTTCCGGTCCAGGTGAATCTTCAGGTAGCGAAGGTTCTTCTGGTCCTGGTGAATCCTCAGGTTCCGGTGGCGAACCATCTGAATCTGGTAGCTCA | 276 |
| LCW0401_059_GFP-N_D05.ab1 | GSGGEPSESGSSGSEGSSGPGESSGESPGGSSGSES | 277 | GGTTCTGGTGGCGAACCATCCGAATCTGGTAGCTCAGGTAGCGAAGGTTCTTCTGGTCCTGGCGAATCTTCAGGTGAATCTCCAGGTGGCTCTAGCGGTTCCGAATCA | 278 |
| LCW0401_060_GFP-N_E05.ab1 | GSGGEPSESGSSGSSESGSSEGGPGSGGEPSESGSS | 279 | GGTTCCGGTGGTGAACCGTCCGAATCTGGTAGCTCAGGTTCCTCTGAAAGCGGTTCTTCCGAGGGTGGTCCAGGTTCCGGTGGTGAACCTTCTGAGTCTGGTAGCTCA | 280 |
| LCW0401_061_GFP-N_F05.ab1 | GSSESGSSEGGPGSGGEPSESGSSGSEGSSGPGESS | 281 | GGTTCCTCTGAAAGCGGTTCTTCTGAGGGCGGTCCAGGTTCTGGTGGCGAACCATCTGAATCTGGTAGCTCAGGTAGCGAAGGTTCTTCCGGTCCGGGTGAATCTTCA | 282 |
| LCW0401_063_GFP-N_H05.ab1 | GSGGEPSESGSSGSESSGPGESSGSEGSSGPGESS | 283 | GGTTCTGGTGGTGAACCGTCCGAATCTGGTAGCTCAGGTAGCGAAGGTTCTTCTGGTCCTGGCGAGTCTTCAGGTAGCGAAGGTTCTTCTGGTCCTGGTGAATCTTCA | 284 |
| LCW0401_066_GFP-N_B06.ab1 | GSGGEPSESGSSGSSESGSSEGGPGSGGEPSESGSS | 285 | GGTTCTGGTGGCGAACCATCCGAGTCTGGTAGCTCAGGTTCTTCCGAAAGCGGTTCTTCCGAAGGCGGTCCAGGTTCTGGTGGTGAACCGTCCGAATCTGGTAGCTCA | 286 |
| LCW0401_067_GFP-N_C06.ab1 | GSGGEPSESGSSGESPGGSSGSESGESPGGSSGSES | 287 | GGTTCCGGTGGCGAACCTTCCGAATCTGGTAGCTCAGGTGAATCTCCGGGTGGTTCTAGCGGTTCCGAATCAGGTGAATCTCCAGGTGGTTCTAGCGGTTCCGAATCA | 288 |
| LCW0401_069_GFP-N_D06.ab1 | GSGGEPSESGSSGSGGEPSESGSSGESPGGSSGSES | 289 | GGTTCCGGTGGTGAACCATCTGAGTCTGGTAGCTCAGGTTCCGGTGGCGAACCGTCCGAGTCTGGTAGCTCAGGTGAATCTCCGGGTGGTTCCAGCGGTTCCGAATCA | 290 |
| LCW0401_070_GFP-N_E06.ab1 | GSEGSSGPGESSGSSESGSSEGGPGSEGSSGPGESS | 291 | GGTAGCGAAGGTTCTTCTGGTCCGGGCGAATCCTCAGGTTCCTCCGAAAGCGGTTCTTCCGAAGGTGGTCCAGGTAGCGAAGGTTCTTCCGGTCCTGGTGAATCTTCA | 292 |
| LCW0401_078_GFP-N_F06.ab1 | GSSESGSSEGGPGESPGGSSGSESGESPGGSSGSES | 293 | GGTTCCTCTGAAAGCGGTTCTTCTGAAGGCGGTCCAGGTGAATCTCCGGGTGGCTCCAGCGGTTCTGAATCAGGTGAATCTCCTGGTGGCTCCAGCGGTTCCGAGTCA | 294 |
| LCW0401_079_GFP-N_G06.ab1 | GSEGSSGPGESSGSESSGPGESSGSGGEPSESGSS | 295 | GGTAGCGAAGGTTCTTCTGGTCCAGGCGAGTCTTCAGGTAGCGAAGGTTCTTCCGGTCCTGGCGAGTCTTCAGGTTCCGGTGGCGAACCGTCCGAATCTGGTAGCTCA | 296 |

Example 2

Construction of XTEN_AE36 Segments

A codon library encoding XTEN sequences of 36 amino acid length was constructed. The XTEN sequence was designated XTEN_AE36. Its segments have the amino acid sequence [α]₃ where X is a 12mer peptide with the sequence: GSPAGSPTSTEE (SEQ ID NO: 297), GSEPATSGSE TP (SEQ ID NO: 298), GTSESA TPESGP (SEQ ID NO: 299), or GTSTEPSEGSAP (SEQ ID NO: 300). The insert was obtained by annealing the following pairs of phosphorylated synthetic oligonucleotide pairs:

```
AE1for:
                                       (SEQ ID NO: 301)
AGGTAGCCCDGCWGGYTCTCCDACYTCYACYGARGA AE1rev:
                                       (SEQ ID NO: 302)
ACCTTCYTCRGTRGARGTHGGAGARCCWGCHGGGCT AE2for:
                                       (SEQ ID NO: 303)
AGGTAGCGAACCKGCWACYTCYGGYTCTGARACYCC AE2rev:
                                       (SEQ ID NO: 304)
ACCTGGRGTYTCAGARCCRGARGTWGCMGGTTCGCT AE3for:
                                       (SEQ ID NO: 305)
AGGTACYTCTGAAAGCGCWACYCCKGARTCYGGYCC AE3rev:
                                       (SEQ ID NO: 306)
ACCTGGRCCRGAYTCMGGRGTWGCGCTTTCAGARGT AE4for:
                                       (SEQ ID NO: 307)
AGGTACYTCTACYGAACCKTCYGARGGYAGCGCWCC AE4rev:
                                       (SEQ ID NO: 308)
ACCTGGWGCGCTRCCYTCRGAMGGTTCRGTAGARGT
```

We also annealed the phosphorylated oligonucleotide 3 KpnIstopperFor: AGGTTCGTCTTCACTCGAGGGTAC (SEQ ID NO: 309) and the non-phosphorylated oligonucleotide pr_3 KpnIstopperRev: CCTCGAGTGAAGACGA (SEQ ID NO: 310). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs for these segments are listed in Table 9.

TABLE 9

DNA and Amino Acid Sequences for 36-mer motifs

| File name | Amino acid sequence | SEQ ID NO: | Nucleotide sequence | SEQ ID NO: |
|---|---|---|---|---|
| LCW0402_002_GFP-N_A07.ab1 | GSPAGSPTSTEEGTSE SATPESGPGTSTEPSE GSAP | 311 | GGTAGCCCGGCAGGCTCTCCGACCTCTACTGAG GAAGGTACTTCTGAAAGCGCAACCCCGGAGTCC GGCCCAGGTACCTCTACCGAACCGTCTGAGGGC AGCGCACCA | 312 |
| LCW0402_003_GFP-N_B07.ab1 | GTSTEPSEGSAPGTST EPSEGSAPGTSTEPSE GSAP | 313 | GGTACTTCTACCGAACCGTCCGAAGGCAGCGCT CCAGGTACCTCTACTGAACCTTCCGAGGGCAGC GCTCCAGGTACCTCTACCGAACCTTCTGAAGGT AGCGCACCA | 314 |
| LCW0402_004_GFP-N_C07.ab1 | GTSTEPSEGSAPGTSE SATPESGPGTSESATP ESGP | 315 | GGTACCTCTACCGAACCGTCTGAAGGTAGCGCA CCAGGTACCTCTGAAAGCGCAACTCCTGAGTCC GGTCCAGGTACTTCTGAAAGCGCAACCCCGGAG TCTGGCCCA | 316 |
| LCW0402_005_GFP-N_D07.ab1 | GTSTEPSEGSAPGTSE SATPESGPGTSESATP ESGP | 317 | GGTACTTCTACTGAACCGTCTGAAGGTAGCGCA CCAGGTACTTCTGAAAGCGCAACCCCGGAATCC GGCCCAGGTACCTCTGAAAGCGCAACCCCGGA GTCCGGCCCA | 318 |
| LCW0402_006_GFP-N_E07.ab1 | GSEPATSGSETPGTSE SATPESGPGSPAGSPT STEE | 319 | GGTAGCGAACCGGCAACCTCCGGCTCTGAAACC CCAGGTACCTCTGAAAGCGCTACTCCTGAATCC GGCCCAGGTAGCCCGGCAGGTTCTCCGACTTCC ACTGAGGAA | 320 |
| LCW0402_008_GFP-N_F07.ab1 | GTSESATPESGPGSEP ATSGSETPGTSTEPSE GSAP | 321 | GGTACTTCTGAAAGCGCAACCCCTGAATCCGGT CCAGGTAGCGAACCGGCTACTTCTGGCTCTGAG ACTCCAGGTACTTCTACCGAACCGTCCGAAGGT AGCGCACCA | 322 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_009_GFP-N_G07.ab1 | GSPAGSPTSTEEGSPAGSPTSTEEGSEPATSGSETP | 323 | GGTAGCCCGGCTGGCTCTCCAACCTCCACTGAGGAAGGTAGCCCGGCTGGCTCTCCAACCTCCACTGAAGAAGGTAGCGAACCGGCTACCTCCGGCTCTGAAACTCCA | 324 |
| LCW0402_011_GFP-N_A08.ab1 | GSPAGSPTSTEEGTSESATPESGPGTSTEPSEGSAP | 325 | GGTAGCCCGGCTGGCTCTCCTACCTCTACTGAGGAAGGTACTTCTGAAAGCGCTACTCCTGAGTCTGGTCCAGGTACCTCTACTGAACCGTCCGAAGGTAGCGCTCCA | 326 |
| LCW0402_012_GFP-N_B08.ab1 | GSPAGSPTSTEEGTSTEPSEGSAP | 327 | GGTAGCCCTGCTGGCTCTCCGACTTCTACTGAGGAAGGTAGCCCGGCTGGTTCTCCGACTTCTACTGAGGAAGGTACTTCTACCGAACCTTCCGAAGGTAGCGCTCCA | 328 |
| LCW0402_013_GFP-N_C08.ab1 | GTSESATPESGPGTSTEPSEGSAPGTSTEPSEGSAP | 329 | GGTACTTCTGAAAGCGCTACTCCGGAGTCCGGTCCAGGTACCTCTACCGAACCGTCCGAAGGCAGCGCTCCAGGTACTTCTACTGAACCTTCTGAGGGTAGCGCTCCA | 330 |
| LCW0402_014_GFP-N_D08.ab1 | GTSTEPSEGSAPGSPAGSPTSTEEGTSTEPSEGSAP | 331 | GGTACCTCTACCGAACCTTCCGAAGGTAGCGCTCCAGGTAGCCCCGGCAGGTTCTCCTACTTCCACTGAGGAAGGTACTTCTACCGAACCTTCTGAGGGTAGCGCACCA | 332 |
| LCW0402_015_GFP-N_E08.ab1 | GSEPATSGSETPGSPAGSPTSTEEGTSESATPESGP | 333 | GGTAGCGAACCGGCTACTTCCGGCTCTGAGACTCCAGGTAGCCCTGCTGGCTCTCCGACCTCTACCGAAGAAGGTACCTCTGAAAGCGCTACCCCTGAGTCTGGCCCA | 334 |
| LCW0402_016_GFP-N_F08.ab1 | GTSTEPSEGSAPGTSESATPESGPGTSESATPESGP | 335 | GGTACTTCTACCGAACCTTCCGAGGGCAGCGCACCAGGTACTTCTGAAAGCGCTACCCCTGAGTCCGGCCCAGGTACTTCTGAAAGCGCTACTCCTGAATCCGGTCCA | 336 |
| LCW0402_020_GFP-N_G08.ab1 | GTSTEPSEGSAPGSEPATSGSETPGSPAGSPTSTEE | 337 | GGTACTTCTACTGAACCGTCTGAAGGCAGCGCACCAGGTAGCGAACCGGCTACTTCCGGTTCTGAAACCCCAGGTAGCCCAGCAGGTTCTCCAACTTCTACTGAAGAA | 338 |
| LCW0402_023_GFP-N_A09.ab1 | GSPAGSPTSTEEGTSESATPESGPGSEPATSGSETP | 339 | GGTAGCCCTGCTGGCTCTCCAACCTCCACCGAAGAAGGTACCTCTGAAAGCGCAACCCCTGAATCCGGCCCAGGTAGCGAACCGGCAACCTCCGGTTCTGAAACCCCA | 340 |
| LCW0402_024_GFP-N_B09.ab1 | GTSESATPESGPGSPAGSPTSTEEGSPAGSPTSTEE | 341 | GGTACTTCTGAAAGCGCTACTCCTGAGTCCGGCCCAGGTAGCCCGGCTGGCTCTCCGACTTCCACCGAGGAAGGTAGCCCGGCTGGCTCTCCAACTTCTACTGAAGAA | 342 |
| LCW0402_025_GFP-N_C09.ab1 | GTSTEPSEGSAPGTSESATPESGPGTSTEPSEGSAP | 343 | GGTACCTCTACTGAACCTTCTGAGGGCAGCGCTCCAGGTACTTCTGAAAGCGCTACCCCGGAGTCCGGTCCAGGTACTTCTACTGAACCGTCCGAAGGTAGCGCACCA | 344 |
| LCW0402_026_GFP-N_D09.ab1 | GSPAGSPTSTEEGTSTEPSEGSAPGSEPATSGSETP | 345 | GGTAGCCCGGCAGGCTCTCCGACTTCCACCGAGGAAGGTACCTCTACTGAACCTTCTGAGGGTAGCGCTCCAGGTAGCGAACCGGCAACCTCTGGCTCTGAAACCCCA | 346 |
| LCW0402_027_GFP-N_E09.ab1 | GSPAGSPTSTEEGTSTEPSEGSAPGTSTEPSEGSAP | 347 | GGTAGCCCAGCAGGCTCTCCGACTTCCACTGAGGAAGGTACTTCTACTGAACCTTCCGAAGGCAGCGCACCAGGTACCTCTACTGAACCTTCTGAGGGCAGCGCTCCA | 348 |
| LCW0402_032_GFP-N_H09.ab1 | GSEPATSGSETPGTSESATPESGPGSPAGSPTSTEE | 349 | GGTAGCGAACCTGCTACCTCCGGTTCTGAAACCCCAGGTACCTCTGAAAGCGCAACTCCGGAGTCTGGTCCAGGTAGCCCTGCAGGTTCTCCTACCTCCACTGAGGAA | 350 |
| LCW0402_034_GFP-N_A10.ab1 | GTSESATPESGPGTSTEPSEGSAPGTSTEPSEGSAP | 351 | GGTACCTCTGAAAGCGCTACTCCGGAGTCTGGCCCAGGTACCTCTACTGAACCGTCTGAGGGTAGCGCTCCAGGTACTTCTACTGAACCGTCCGAAGGTAGCGCACCA | 352 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_036_GFP-N_C10.ab1 | GSPAGSPTSTEEGTST EPSEGSAPGTSTEPSE GSAP | 353 | GGTAGCCCGGCTGGTTCTCCGACTTCCACCGAG GAAGGTACCTCTACTGAACCTTCTGAGGGTAGC GCTCCAGGTACCTCTACTGAACCTTCCGAAGGC AGCGCTCCA | 354 |
| LCW0402_039_GFP-N_E10.ab1 | GTSTEPSEGSAPGTST EPSEGSAPGTSTEPSE GSAP | 355 | GGTACTTCTACCGAACCGTCCGAGGGCAGCGCT CCAGGTACTTCTACTGAACCTTCTGAAGGCAGC GCTCCAGGTACTTCTACTGAACCTTCCGAAGGT AGCGCACCA | 356 |
| LCW0402_040_GFP-N_F10.ab1 | GSEPATSGSETPGTSE SATPESGPGTSTEPSE GSAP | 357 | GGTAGCGAACCTGCAACCTCTGGCTCTGAAACC CCAGGTACCTCTGAAAGCGCTACTCCTGAATCT GGCCCAGGTACTTCTACTGAACCGTCCGAGGGC AGCGCACCA | 358 |
| LCW0402_041_GFP-N_G10.ab1 | GTSTEPSEGSAPGSPA GSPTSTEEGTSTEPSE GSAP | 359 | GGTACTTCTACCGAACCGTCCGAGGGTAGCGCA CCAGGTAGCCCAGCAGGTTCTCCTACCTCCACC GAGGAAGGTACTTCTACCGAACCGTCCGAGGGT AGCGCACCA | 360 |
| LCW0402_050_GFP-N_A11.ab1 | GSEPATSGSETPGTSE SATPESGPGSEPATSG SETP | 361 | GGTAGCGAACCGGCAACCTCCGGCTCTGAAACT CCAGGTACTTCTGAAAGCGCTACTCCGGAATCC GGCCCAGGTAGCGAACCGGCTACTTCCGGCTCT GAAACCCCA | 362 |
| LCW0402_051_GFP-N_B11.ab1 | GSEPATSGSETPGTSE SATPESGPGSEPATSG SETP | 363 | GGTAGCGAACCGGCAACTTCCGGCTCTGAAACC CCAGGTACTTCTGAAAGCGCTACTCCTGAGTCT GGCCCAGGTAGCGAACCTGCTACCTCTGGCTCT GAAACCCCA | 364 |
| LCW0402_059_GFP-N_E11.ab1 | GSEPATSGSETPGSEP ATSGSETPGTSTEPSE GSAP | 365 | GGTAGCGAACCGGCAACCTCTGGCTCTGAAACT CCAGGTAGCGAACCTGCAACCTCCGGCTCTGAA ACCCCAGGTACTTCTACTGAACCTTCTGAGGGC AGCGCACCA | 366 |
| LCW0402_060_GFP-N_F11.ab1 | GTSESATPESGPGSEP ATSGSETPGSEPATSG SETP | 367 | GGTACTTCTGAAAGCGCTACCCCGGAATCTGGC CCAGGTAGCGAACCGGCTACTTCTGGTTCTGAA ACCCCAGGTAGCGAACCGGCTACCTCCGGTTCT GAAACTCCA | 368 |
| LCW0402_061_GFP-N_G11.ab1 | GTSTEPSEGSAPGTST EPSEGSAPGTSESATP ESGP | 369 | GGTACCTCTACTGAACCTTCCGAAGGCAGCGCT CCAGGTACCTCTACCGAACCGTCCGAGGGCAGC GCACCAGGTACTTCTGAAAGCGCAACCCCTGAA TCCGGTCCA | 370 |
| LCW0402_065_GFP-N_A12.ab1 | GSEPATSGSETPGTSE SATPESGPGTSESATP ESGP | 371 | GGTAGCGAACCGGCAACCTCTGGCTCTGAAACC CCAGGTACCTCTGAAAGCGCTACTCCGGAATCT GGTCCAGGTACTTCTGAAAGCGCTACTCCGGAA TCCGGTCCA | 372 |
| LCW0402_066_GFP-N_B12.ab1 | GSEPATSGSETPGSEP ATSGSETPGTSTEPSE GSAP | 373 | GGTAGCGAACCTGCTACCTCCGGCTCTGAAACT CCAGGTAGCGAACCGGCTACTTCCGGTTCTGAA ACTCCAGGTACCTCTACCGAACCTTCCGAAGGC AGCGCACCA | 374 |
| LCW0402_067_GFP-N_C12.ab1 | GSEPATSGSETPGTST EPSEGSAPGSEPATSG SETP | 375 | GGTAGCGAACCTGCTACTTCTGGTTCTGAAACT CCAGGTACTTCTACCGAACCGTCCGAGGGTAGC GCTCCAGGTAGCGAACCTGCTACTTCTGGTTCT GAAACTCCA | 376 |
| LCW0402_069_GFP-N_D12.ab1 | GTSTEPSEGSAPGTST EPSEGSAPGSEPATSG SETP | 377 | GGTACCTCTACCGAACCGTCCGAGGGTAGCGCA CCAGGTACCTCTACTGAACCGTCTGAGGGTAGC GCTCCAGGTAGCGAACCGGCAACCTCCGGTTCT GAAACTCCA | 378 |
| LCW0402_073_GFP-N_F12.ab1 | GTSTEPSEGSAPGSEP ATSGSETPGSPAGSPT STEE | 379 | GGTACTTCTACTGAACCTTCCGAAGGTAGCGCT CCAGGTAGCGAACCTGCTACTTCTGGTTCTGAA ACCCCAGGTAGCCCGGCTGGCTCTCCGACCTCC ACCGAGGAA | 380 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_074_GFP-N_G12.ab1 | GSEPATSGSETPGSPA GSPTSTEEGTSESATP ESGP | 381 | GGTAGCGAACCGGCTACTTCCGGCTCTGAGACT CCAGGTAGCCCAGCTGGTTCTCCAACCTCTACT GAGGAAGGTACTTCTGAAAGCGCTACCCCTGAA TCTGGTCCA | 382 |
| LCW0402_075_GFP-N_H12.ab1 | GTSESATPESGPGSEP ATSGSETPGTSESATP ESGP | 383 | GGTACCTCTGAAAGCGCAACTCCTGAGTCTGGC CCAGGTAGCGAACCTGCTACCTCCGGCTCTGAG ACTCCAGGTACCTCTGAAAGCGCAACCCCGGAA TCTGGTCCA | 384 |

Example 3

Construction of XTEN_AF36 Segments

A codon library encoding sequences of 36 amino acid length was constructed. The sequences were designated XTEN_AF36. Its segments have the amino acid sequence [X]3 where X is a 12mer peptide with the sequence: GST-SESPSGTAP (SEQ ID NO: 385), GTSTPESGSASP (SEQ ID NO: 386), GTSPSGESSTAP (SEQ ID NO: 387), or GSTSSTAESPGP (SEQ ID NO: 388). The insert was obtained by annealing the following pairs of phosphorylated synthetic oligonucleotide pairs:

```
AF1for:
                                (SEQ ID NO: 389)
AGGTTCTACYAGCGAATCYCCKTCTGGYACYGCWCC AF1rev:
                                (SEQ ID NO: 390)
ACCTGGWGCRGTRCCAGAMGGRGATTCGCTRGTAGA AF2for:
                                (SEQ ID NO: 391)
AGGTACYTCTACYCCKGAAAGCGGYTCYGCWTCTCC AF2rev:
                                (SEQ ID NO: 392)
ACCTGGAGAWGCRGARCCGCTTTCMGGRGTAGARGT AF3for:
                                (SEQ ID NO: 393)
AGGTACYTCYCCKAGCGGYGAATCTTCTACYGCWCC AF3rev:
                                (SEQ ID NO: 394)
ACCTGGWGCRGTAGAAGATTCRCCGCTMGGRGARGT
```

```
AF4for:
                                (SEQ ID NO: 395)
AGGTTCYACYAGCTCTACYGCWGAATCTCCKGGYCC AF4rev:
                                (SEQ ID NO: 396)
ACCTGGRCCMGGAGATTCWGCRGTAGAGCTRGTRGA
```

We also annealed the phosphorylated oligonucleotide 3 KpnIstopperFor: AGGTTCGTCTTCACTCGAGGGTAC (SEQ ID NO: 397) and the non-phosphorylated oligonucleotide pr_3 KpnIstopperRev: CCTCGAGTGAAGACGA (SEQ ID NO: 398). The annealed oligonucleotide pairs were ligated, which resulted in a mixture of products with varying length that represents the varying number of 12mer repeats ligated to one BbsI/KpnI segment The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs for these segments are listed in Table 10.

TABLE 10

DNA and Amino Acid Sequences for 36-mer motifs

| File name | Amino acid sequence | SEQ ID NO: | Nucleotide sequence | SEQ ID NO: |
|---|---|---|---|---|
| LCW0403_004_GFP-N_A01.ab1 | GTSTPESGSASPGTSP SGESSTAPGTSPSGES STAP | 399 | GGTACTTCTACTCCGGAAAGCGGTTCCGCATCTCC AGGTACTTCTCCTAGCGGTGAATCTTCTACTGCTC CAGGTACCTCTCCTAGCGGCGAATCTTCTACTGCT CCA | 400 |
| LCW0403_005_GFP-N_B01.ab1 | GTSPSGESSTAPGSTS STAESPGPGTSPSGES STAP | 401 | GGTACTTCTCCGAGCGGTGAATCTTCTACCGCACC AGGTTCTACTAGCTCTACCGCTGAATCTCCGGGCC CAGGTACTTCTCCGAGCGGTGAATCTTCTACTGCT CCA | 402 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_006_GFP-N_C01.ab1 | GSTSSTAESPGPGTSP SGESSTAPGTSTPESG SASP | 403 | GGTTCCACCAGCTCTACTGCTGAATCTCCTGGTCC AGGTACCTCTCCTAGCGGTGAATCTTCTACTGCTC CAGGTACTTCTACTCCTGAAAGCGGCTCTGCTTCT CCA | 404 |
| LCW0403_007_GFP-N_D01.ab1 | GSTSSTAESPGPGTSTS TAESPGPGTSPSGES STAP | 405 | GGTTCTACCAGCTCTACTGCAGAATCTCCTGGCCC AGGTTCCACCAGCTCTACCGCAGAATCTCCGGGT CCAGGTACTTCCCCTAGCGGTGAATCTTCTACCGC ACCA | 406 |
| LCW0403_008_GFP-N_E01.ab1 | GSTSSTAESPGPGTSP SGESSTAPGTSTPESG SASP | 407 | GGTTCTACTAGCTCTACTGCTGAATCTCCTGGCCC AGGTACTTCTCCTAGCGGTGAATCTTCTACCGCTC CAGGTACCTCTACTCCGGAAAGCGGTTCTGCATCT CCA | 408 |
| LCW0403_010_GFP-N_F01.ab1 | GSTSSTAESPGPGTST PESGSASPGSTSESPS GTAP | 409 | GGTTCTACCAGCTCTACCGCAGAATCTCCTGGTCC AGGTACCTCTACTCCGGAAAGCGGCTCTGCATCT CCAGGTTCTACTAGCGAATCTCCTTCTGGCACTGC ACCA | 410 |
| LCW0403_011_GFP-N_G01.ab1 | GSTSSTAESPGPGTST PESGSASPGTSTPESG SASP | 411 | GGTTCTACTAGCTCTACTGCAGAATCTCCTGGCCC AGGTACCTCTACTCCGGAAAGCGGCTCTGCATCT CCAGGTACTTCTACCCCTGAAAGCGGTTCTGCATC TCCA | 412 |
| LCW0403_012_GFP-N_H01.ab1 | GSTSESPSGTAPGTSP SGESSTAPGSTSESPS GTAP | 413 | GGTTCTACCAGCGAATCTCCTTCTGGCACCGCTCC AGGTACCTCTCCTAGCGGCGAATCTTCTACCGCTC CAGGTTCTACTAGCGAATCTCCTTCTGGCACTGCA CCA | 414 |
| LCW0403_013_GFP-N_A02.ab1 | GSTSSTAESPGPGTSTS TAESPGPGTSPSGES STAP | 415 | GGTTCCACCAGCTCTACTGCAGAATCTCCGGGCC CAGGTTCTACTAGCTCTACTGCAGAATCTCCGGGT CCAGGTACTTCTCCTAGCGGCGAATCTTCTACCGC TCCA | 416 |
| LCW0403_014_GFP-N_B02.ab1 | GSTSSTAESPGPGTST PESGSASPGSTSESPS GTAP | 417 | GGTTCCACTAGCTCTACTGCAGAATCTCCTGGCCC AGGTACCTCTACCCCTGAAAGCGGCTCTGCATCTC CAGGTTCTACCAGCGAATCCCCGTCTGGCACCGC ACCA | 418 |
| LCW0403_015_GFP-N_C02.ab1 | GSTSSTAESPGPGSTS STAESPGPGTSPSGES STAP | 419 | GGTTCTACTAGCTCTACTGCTGAATCTCCGGGTCC AGGTTCTACCAGCTCTACTGCTGAATCTCCTGGTC CAGGTACCTCCCCGAGCGGTGAATCTTCTACTGC ACCA | 420 |
| LCW0403_017_GFP-N_D02.ab1 | GSTSSTAESPGPGSTS ESPSGTAPGSTSSTAE SPGP | 421 | GGTTCTACCAGCTCTACCGCTGAATCTCCTGGCCC AGGTTCTACCAGCGAATCCCCGTCTGGCACCGCA CCAGGTTCTACTAGCTCTACCGCTGAATCTCCGGG TCCA | 422 |
| LCW0403_018_GFP-N_E02.ab1 | GSTSSTAESPGPGSTS STAESPGPGSTSSTAE SPGP | 423 | GGTTCTACCAGCTCTACCGCAGAATCTCCTGGCCC AGGTTCCACTAGCTCTACCGCTGAATCTCCTGGTC CAGGTTCTACTAGCTCTACCGCTGAATCTCCTGGT CCA | 424 |
| LCW0403_019_GFP-N_F02.ab1 | GSTSESPSGTAPGSTS STAESPGPGSTSSTAE SPGP | 425 | GGTTCTACTAGCGAATCCCCTTCTGGTACTGCTCC AGGTTCCACTAGCTCTACCGCTGAATCTCCTGGCC CAGGTTCCACTAGCTCTACTGCAGAATCTCCTGGT CCA | 426 |
| LCW0403_023_GFP-N_H02.ab1 | GSTSESPSGTAPGSTS ESPSGTAPGSTSESPS GTAP | 427 | GGTTCTACTAGCGAATCTCCTTCTGGTACCGCTCC AGGTTCTACCAGCGAATCCCCGTCTGGTACTGCTC CAGGTTCTACCAGCGAATCTCCTTCTGGTACTGCA CCA | 428 |
| LCW0403_024_GFP-N_A03.ab1 | GSTSSTAESPGPGSTS STAESPGPGSTSSTAE SPGP | 429 | GGTTCCACCAGCTCTACTGCTGAATCTCCTGGCCC AGGTTCTACCAGCTCTACTGCTGAATCTCCGGGCC CAGGTTCCACCAGCTCTACCGCTGAATCTCCGGGT CCA | 430 |
| LCW0403_025_GFP-N_B03.ab1 | GSTSSTAESPGPGSTS STAESPGPGTSPSGES STAP | 431 | GGTTCCACTAGCTCTACCGCAGAATCTCCTGGTCC AGGTTCTACTAGCTCTACTGCTGAATCTCCGGGTC CAGGTACCTCCCCTAGCGGCGAATCTTCTACCGCT CCA | 432 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_028_GFP-N_D03.ab1 | GSSPSASTGTGPGSSTPSGATGSPGSSTPSGATGSP | 433 | GGTTCTAGCCCTTCTGCTTCCACCGGTACCGGCCCAGGTAGCTCTACTCCGTCTGGTGCAACTGGCTCTCCAGGTAGCTCTACTCCGTCTGGTGCAACCGGCTCCCCA | 434 |
| LCW0403_029_GFP-N_E03.ab1 | GTSPSGESSTAPGTSTPESGSASPGSTSSTAESPGP | 435 | GGTACTTCCCCTAGCGGTGAATCTTCTACTGCTCCAGGTACCTCTACTCCGAAAGCGGCTCCGCATCTCCAGGTTCTACTAGCTCTACTGCTGAATCTCCTGGTCCA | 436 |
| LCW0403_030_GFP-N_F03.ab1 | GSTSSTAESPGPGSTSSTAESPGPGTSTPESGSASP | 437 | GGTTCTACTAGCTCTACCGCTGAATCTCCGGGTCCAGGTTCTACCAGCTCTACTGCAGAATCTCCTGGCCCAGGTACTTCTACTCCGGAAAGCGGTTCCGCTTCTCCA | 438 |
| LCW0403_031_GFP-N_G03.ab1 | GTSPSGESSTAPGSTSSTAESPGPGTSTPESGSASP | 439 | GGTACTTCTCCTAGCGGTGAATCTTCTACCGCTCCAGGTTCTACCAGCTCTACTGCTGAATCTCCTGGCCCAGGTACTTCTACCCCGGAAAGCGGCTCCGCTTCTCCA | 440 |
| LCW0403_033_GFP-N_H03.ab1 | GSTSESPSGTAPGSTSSTAESPGPGSTSSTAESPGP | 441 | GGTTCTACTAGCGAATCCCCTTCTGGTACTGCACCAGGTTCTACCAGCTCTACTGCTGAATCTCCGGGCCCAGGTTCCACCAGCTCTACCGCAGAATCTCCTGGTCCA | 442 |
| LCW0403_035_GFP-N_A04.ab1 | GSTSSTAESPGPGSTSESPSGTAPGSTSSTAESPGP | 443 | GGTTCCACCAGCTCTACCGCTGAATCTCCGGGCCCAGGTTCTACCAGCGAATCCCCTTCTGGCACTGCACCAGGTTCTACTAGCTCTACCGCAGAATCTCCGGGCCCA | 444 |
| LCW0403_036_GFP-N_B04.ab1 | GSTSSTAESPGPGTSPSGESSTAPGTSTPESGSASP | 445 | GGTTCTACCAGCTCTACTGCTGAATCTCCGGGTCCAGGTACTTCCCCGAGCGGTGAATCTTCTACTGCACCAGGTACTTCTACTCCGGAAAGCGGTTCCGCTTCTCCA | 446 |
| LCW0403_039_GFP-N_C04.ab1 | GSTSESPSGTAPGSTSESPSGTAPGTSPSGESSTAP | 447 | GGTTCTACCAGCGAATCTCCTTCTGGCACCGCTCCAGGTTCTACTAGCGAATCCCCGTCTGGTACCGCACCAGGTACTTCTCCTAGCGGCGAATCTTCTACCGCACCA | 448 |
| LCW0403_041_GFP-N_D04.ab1 | GSTSESPSGTAPGSTSESPSGTAPGTSTPESGSASP | 449 | GGTTCTACCAGCGAATCCCCTTCTGGTACTGCTCCAGGTTCTACCAGCGAATCCCCTTCTGGCACCGCACCAGGTACTTCTACCCCGAAAGCGGCTCCGCTTCTCCA | 450 |
| LCW0403_044_GFP-N_E04.ab1 | GTSTPESGSASPGSTSSTAESPGPGSTSSTAESPGP | 451 | GGTACCTCTACTCCTGAAAGCGGTTCTGCATCTCCAGGTTCCACTAGCTCTACCGCAGAATCTCCGGGCCCAGGTTCTACTAGCTCTACTGCTGAATCTCCTGGCCCA | 452 |
| LCW0403_046_GFP-N_F04.ab1 | GSTSESPSGTAPGSTSESPSGTAPGTSPSGESSTAP | 453 | GGTTCTACCAGCGAATCCCCTTCTGGCACTGCACCAGGTTCTACTAGCGAATCCCCTTCTGGTACCGCACCAGGTACTTCTCCGAGCGGCGAATCTTCTACTGCTCCA | 454 |
| LCW0403_047_GFP-N_G04.ab1 | GSTSSTAESPGPGSTSSTAESPGPGSTSESPSGTAP | 455 | GGTTCTACTAGCTCTACCGCTGAATCTCCTGGCCCAGGTTCCACTAGCTCTACCGCAGAATCTCCGGGCCCAGGTTCTACTAGCGAATCCCCTTCTGGTACCGCTCCA | 456 |
| LCW0403_049_GFP-N_H04.ab1 | GSTSSTAESPGPGSTSSTAESPGPGTSTPESGSASP | 457 | GGTTCCACCAGCTCTACTGCAGAATCTCCTGGCCCAGGTTCTACTAGCTCTACCGCAGAATCTCCTGGTCCAGGTACCTCTACTCCTGAAAGCGGTTCCGCATCTCCA | 458 |
| LCW0403_051_GFP-N_A05.ab1 | GSTSSTAESPGPGSTSSTAESPGPGSTSESPSGTAP | 459 | GGTTCTACTAGCTCTACTGCTGAATCTCCGGGCCCAGGTTCTACTAGCTCTACCGCTGAATCTCCGGGTCCAGGTTCTACTAGCGAATCTCCTTCTGGTACCGCTCCA | 460 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_053_GFP-N_B05.ab1 | GTSPSGESSTAPGSTS ESPSGTAPGSTSSTAE SPGP | 461 | GGTACCTCCCCGAGCGGTGAATCTTCTACTGCACC AGGTTCTACTAGCGAATCCCCTTCTGGTACTGCTC CAGGTTCCACCAGCTCTACTGCAGAATCTCCGGG TCCA | 462 |
| LCW0403_054_GFP-N_C05.ab1 | GSTSESPSGTAPGTSP SGESSTAPGSTSSTAE SPGP | 463 | GGTTCTACTAGCGAATCCCCGTCTGGTACTGCTCC AGGTACTTCCCCTAGCGGTGAATCTTCTACTGCTC CAGGTTCTACCAGCTCTACCGCAGAATCTCCGGG TCCA | 464 |
| LCW0403_057_GFP-N_D05.ab1 | GSTSSTAESPGPGSTS ESPSGTAPGTSPSGES STAP | 465 | GGTTCTACCAGCTCTACCGCTGAATCTCCTGGCCC AGGTTCTACTAGCGAATCTCCGTCTGGCACCGCA CCAGGTACTTCCCCTAGCGGTGAATCTTCTACTGC ACCA | 466 |
| LCW0403_058_GFP-N_E05.ab1 | GSTSESPSGTAPGSTS ESPSGTAPGTSTPESG SASP | 467 | GGTTCTACTAGCGAATCTCCTTCTGGCACTGCACC AGGTTCTACCAGCGAATCTCCGTCTGGCACTGCA CCAGGTACCTCTACCCCTGAAAGCGGTTCCGCTTC TCCA | 468 |
| LCW0403_060_GFP-N_F05.ab1 | GTSTPESGSASPGSTS ESPSGTAPGSTSSTAE SPGP | 469 | GGTACCTCTACTCCGGAAAGCGGTTCCGCATCTCC AGGTTCTACCAGCGAATCCCGTCTGGCACCGCA CCAGGTTCTACTAGCTCTACTGCTGAATCTCCGGG CCCA | 470 |
| LCW0403_063_GFP-N_G05.ab1 | GSTSSTAESPGPGTSP SGESSTAPGTSPSGES STAP | 471 | GGTTCTACTAGCTCTACTGCAGAATCTCCGGGCCC AGGTACCTCTCCTAGCGGTGAATCTTCTACCGCTC CAGGTACTTCTCCGAGCGGTGAATCTTCTACCGCT CCA | 472 |
| LCW0403_064_GFP-N_H05.ab1 | GTSPSGESSTAPGTSP SGESSTAPGTSPSGES STAP | 473 | GGTACCTCCCCTAGCGGCGAATCTTCTACTGCTCC AGGTACCTCTCCTAGCGGCGAATCTTCTACCGCTC CAGGTACCTCCCCTAGCGGTGAATCTTCTACCGCA CCA | 474 |
| LCW0403_065_GFP-N_A06.ab1 | GSTSSTAESPGPGTST PESGSASPGSTSESPS GTAP | 475 | GGTTCCACTAGCTCTACTGCTGAATCTCCTGGCCC AGGTACTTCTACTCCGGAAAGCGGTTCCGCTTCTC CAGGTTCTACTAGCGAATCTCCGTCTGGCACCGC ACCA | 476 |
| LCW0403_066_GFP-N_B06.ab1 | GSTSESPSGTAPGTSP SGESSTAPGTSPSGES STAP | 477 | GGTTCTACTAGCGAATCTCCGTCTGGCACTGCTCC AGGTACTTCTCCTAGCGGTGAATCTTCTACCGCTC CAGGTACTTCCCCTAGCGGCGAATCTTCTACCGCT CCA | 478 |
| LCW0403_067_GFP-N_C06.ab1 | GSTSESPSGTAPGTST PESGSASPGSTSSTAE SPGP | 479 | GGTTCTACTAGCGAATCTCCTTCTGGTACCGCTCC AGGTACTTCTACCCCTGAAAGCGGCTCCGCTTCTC CAGGTTCCACTAGCTCTACCGCTGAATCTCCGGGT CCA | 480 |
| LCW0403_068_GFP-N_D06.ab1 | GSTSSTAESPGPGSTS STAESPGPGSTSESPS GTAP | 481 | GGTTCCACTAGCTCTACTGCTGAATCTCCTGGCCC AGGTTCTACCAGCTCTACCGCTGAATCTCCTGGCC CAGGTTCTACCAGCGAATCTCCGTCTGGCACCGC ACCA | 482 |
| LCW0403_069_GFP-N_E06.ab1 | GSTSESPSGTAPGTST PESGSASPGTSTPESG SASP | 483 | GGTTCTACTAGCGAATCCCGTCTGGTACCGCACC AGGTACTTCTACCCCGGAAAGCGGCTCTGCTTCTC CAGGTACTTCTACCCCCGAAAGCGGCTCCGCATC TCCA | 484 |
| LCW0403_070_GFP-N_F06.ab1 | GSTSESPSGTAPGTST PESGSASPGTSTPESG SASP | 485 | GGTTCTACTAGCGAATCCCGTCTGGTACTGCTCC AGGTACTTCTACTCCTGAAAGCGGTTCCGCTTCTC CAGGTACCTCTACTCCGGAAAGCGGTTCTGCATCT CCA | 486 |

Example 4

Construction of XTEN_AG36 Segments

A codon library encoding sequences of 36 amino acid length was constructed. The sequences were designated XTEN_AG36. Its segments have the amino acid sequence [α]$_3$ where X is a 12mer peptide with the sequence: GTPGS-GTASSSP (SEQ ID NO: 487), GSSTPSGATGSP (SEQ ID NO: 488), GSSPSASTGTGP (SEQ ID NO: 489), or GASPGTSSTGSP (SEQ ID NO: 490). The insert was obtained by annealing the following pairs of phosphorylated synthetic oligonucleotide pairs:

```
AG1for:
                                      (SEQ ID NO: 491)
AGGTACYCCKGGYAGCGGTACYGCWTCTTCYTCTCC AG1rev:
                                      (SEQ ID NO: 492)
ACCTGGAGARGAAGAWGCRGTACCGCTRCCMGGRGT AG2for:
                                      (SEQ ID NO: 493)
AGGTAGCTCTACYCCKTCTGGTGCWACYGGYTCYCC AG2rev:
                                      (SEQ ID NO: 494)
ACCTGGRGARCCRGTWGCACCAGAMGGRGTAGAGCT AG3for:
                                      (SEQ ID NO: 495)
AGGTTCTAGCCCKTCTGCWTCYACYGGTACYGGYCC AG3rev:
                                      (SEQ ID NO: 496)
ACCTGGRCCRGTACCRGTRGAWGCAGAMGGGCTAGA AG4for:
                                      (SEQ ID NO: 497)
AGGTGCWTCYCCKGGYACYAGCTCTACYGGTTCTCC AG4rev:
                                      (SEQ ID NO: 498)
ACCTGGAGAACCRGTAGAGCTRGTRCCMGGRGAWGC
```

We also annealed the phosphorylated oligonucleotide 3 KpnIstopperFor: AGGTTCGTCTTCACTCGAGGGTAC (SEQ ID NO: 499) and the non-phosphorylated oligonucleotide pr_3 KpnIstopperRev: CCTCGAGTGAAGACGA (SEQ ID NO: 500). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs for these segments are listed in Table 11.

TABLE 11

DNA and Amino Acid Sequences for 36-mer motifs

| File Name | Amino acid sequence | SEQ ID NO: | Nucleotide sequence | SEQ ID NO: |
|---|---|---|---|---|
| LCW0404_001_GFP-N_A07.ab1 | GASPGTSSTGSPGTPG SGTASSSPGSSTPSGA TGSP | 501 | GGTGCATCCCCGGGCACTAGCTCTACCGGTTCTCCAGG TACTCCTGGTAGCGGTACTGCTTCTTCTTCTCCAGGTA GCTCTACTCCTTCTGGTGCTACTGGTTCTCCA | 502 |
| LCW0404_003_GFP-N_B07.ab1 | GSSTPSGATGSPGSSP SASTGTGPGSSTPSGA TGSP | 503 | GGTAGCTCTACCCCTTCTGGTGCTACCGGCTCTCCAGG TTCTAGCCCGTCTGCTTCTACCGGTACCGGTCCAGGTA GCTCTACCCCTTCTGGTGCTACTGGTTCTCCA | 504 |
| LCW0404_006_GFP-N_C07.ab1 | GASPGTSSTGSPGSSP SASTGTGPGSSTPSGA TGSP | 505 | GGTGCATCTCCGGGTACTAGCTCTACCGGTTCTCCAGG TTCTAGCCCTTCTGCTTCCACTGGTACCGGCCCAGGTA GCTCTACCCCGTCTGGTGCTACTGGTTCCCA | 506 |
| LCW0404_007_GFP-N_D07.ab1 | GTPGSGTASSSPGSST PSGATGSPGASPGTSS TGSP | 507 | GGTACTCCGGGCAGCGGTACTGCTTCTTCCCTCTCCAGG TAGCTCTACCCCTTCTGGTGCAACTGGTTCCCCAGGTG CATCCCTGGTACTAGCTCTACCGGTTCTCCA | 508 |
| LCW0404_009_GFP-N_E07.ab1 | GTPGSGTASSSPGASP GTSSTGSPGSRPSAST GTGP | 509 | GGTACCCCTGGCAGCGGTACTGCTTCTTCTTCTCCAGG TGCTTCCCCTGGTACCAGCTCTACCGGTTCTCCAGGTT CTAGACCTTCTGCATCCACCGGTACTGGTCCA | 510 |
| LCW0404_011_GFP-N_F07.ab1 | GASPGTSSTGSPGSST PSGATGSPGASPGTSS TGSP | 511 | GGTGCATCTCCTGGTACCAGCTCTACCGGTTCTCCAGG TAGCTCTACTCCTTCTGGTGCTACTGGCTCTCCAGGTG CTTCCCCGGGTACCAGCTCTACCGGTTCTCCA | 512 |
| LCW0404_012_GFP-N_G07.ab1 | GTPGSGTASSSPGSST PSGATGSPGSSTPSGA TGSP | 513 | GGTACCCCGGGCAGCGGTACCGCATCTTCCTCTCCAGG TAGCTCTACCCCGTCTGGTGCTACCGGTTCCCCAGGTA GCTCTACCCCGTCTGGTGCAACCGGCTCCCCA | 514 |

TABLE 11-continued

DNA and Amino Acid Sequences for 36-mer motifs

| File Name | Amino acid sequence | SEQ ID NO: | Nucleotide sequence | SEQ ID NO: |
|---|---|---|---|---|
| LCW0404_014_GFP-N_H07.ab1 | GASPGTSSTGSPGASP GTSSTGSPGASPGTSS TGSP | 515 | GGTGCATCTCCGGGCACTAGCTCTACTGGTTCTCCAGG TGCATCCCTGGCACTAGCTCTACTGGTTCTCCAGGTG CTTCTCCTGGTACCAGCTCTACTGGTTCTCCA | 516 |
| LCW0404_015_GFP-N_A08.ab1 | GSSTPSGATGSPGSSP SASTGTGPGASPGTSS TGSP | 517 | GGTAGCTCTACTCCGTCGGTGCAACCGGTCCCCAGG TTCTAGCCCGTCTGCTTCCACTGGTACTGGCCCAGGT CTTCCCCGGGCACCAGCTCTACTGGTTCTCCA | 518 |
| LCW0404_016_GFP-N_B08.ab1 | GSSTPSGATGSPGSST PSGATGSPGTPGSGT ASSSP | 519 | GGTAGCTCTACTCCTTCTGGTGCTACCGGTTCCCCAGG TAGCTCTACTCCTTCTGGTGCTACTGGTTCCCCAGGTA CTCCGGGCAGCGGTACTGCTTCTTCCTCTCCA | 520 |
| LCW0404_017_GFP-N_C08.ab1 | GSSTPSGATGSPGSST PSGATGSPGASPGTSS TGSP | 521 | GGTAGCTCTACTCCGTCGGTGCAACCGGTTCCCCAGG TAGCTCTACTCCTTCTGGTGCTACTGGCTCCCCAGGTG CATCCCCTGGCACCAGCTCTACCGGTTCTCCA | 522 |
| LCW0404_018_GFP-N_D08.ab1 | GTPGSGTASSSPGSSP SASTGTGPGSSTPSGA TGSP | 523 | GGTACTCCTGGTAGCGGTACCGCATCTTCCTCTCCAGG TTCTAGCCCTTCTGCATCTACCGGTACCGGTCCAGGTA GCTCTACTCCTTCTGGTGCTACTGGCTCTCCA | 524 |
| LCW0404_023_GFP-N_F08.ab1 | GASPGTSSTGSPGSSP SASTGTGPGTPGSGT ASSSP | 525 | GGTGCTTCCCCGGGCACTAGCTCTACCGGTTCTCCAGG TTCTAGCCCTTCTGCATCTACTGGTACTGGCCCAGGTA CTCCGGGCAGCGGTACTGCTTCTTCCTCTCCA | 526 |
| LCW0404_025_GFP-N_G08.ab1 | GSSTPSGATGSPGSST PSGATGSPGASPGTSS TGSP | 527 | GGTAGCTCTACTCCGTCTGGTGCTACCGGTCTCCAGG TAGCTCTACCCCTTCTGGTGCAACCGGCTCCCCAGGTG CTTCTCCGGGTACCAGCTCTACTGGTTCTCCA | 528 |
| LCW0404_029_GFP-N_A09.ab1 | GTPGSGTASSSPGSST PSGATGSPGSSPSAST GTGP | 529 | GGTACCCCTGGCAGCGGTACCGCTTCTTCCTCTCCAGG TAGCTCTACCCCGTCTGGTGCTACTGGCTCTCCAGGTT CTAGCCCGTCTGCATCTACCGGTACCGGCCCA | 530 |
| LCW0404_030_GFP-N_B09.ab1 | GSSTPSGATGSPGTPG SGTASSSPGTPGSGTA SSSP | 531 | GGTAGCTCTACTCCTTCTGGTGCAACCGGCTCCCCAGG TACCCCGGGCAGCGGTACCGCATCTTCCTCTCCAGGTA CTCCGGGTAGCGGTACTGCTTCTTCTTCTCCA | 532 |
| LCW0404_031_GFP-N_C09.ab1 | GTPGSGTASSSPGSST PSGATGSPGASPGTSS TGSP | 533 | GGTACCCCGGGTAGCGGTACTGCTTCTTCCTCTCCAGG TAGCTCTACCCCTTCTGGTGCAACCGGCTCTCCAGGTG CTTCTCCGGGCACCAGCTCTACCGGTTCTCCA | 534 |
| LCW0404_034_GFP-N_D09.ab1 | GSSTPSGATGSPGSST PSGATGSPGASPGTSS TGSP | 535 | GGTAGCTCTACCCCGTCTGGTGCTACCGGCTCTCCAGG TAGCTCTACCCCGTCTGGTGCAACCGGCTCCCCAGGTG CATCCCCGGGTACTAGCTCTACCGGTTCTCCA | 536 |
| LCW0404_035_GFP-N_E09.ab1 | GASPGTSSTGSPGTPG SGTASSSPGSSTPSGA TGSP | 537 | GGTGCTTCTCCGGGCACCAGCTCTACTGGTTCTCCAGG TACCCCGGGCAGCGGTACCGCATCTTCTTCTCCAGGTA GCTCTACTCCTTCTGGTGCAACTGGTTCTCCA | 538 |
| LCW0404_036_GFP-N_F09.ab1 | GSSPSASTGTGPGSST PSGATGSPGTPGSGT ASSSP | 539 | GGTTCTAGCCCGTCTGCTTCCACCGGTACTGGCCCAGG TAGCTCTACCCCGTCTGGTGCAACTGGTTCCCCAGGTA CCCCTGGTAGCGGTACCGCTTCTTCTTCTCCA | 540 |
| LCW0404_037_GFP-N_G09.ab1 | GASPGTSSTGSPGSSP SASTGTGPGSSTPSGA TGSP | 541 | GGTGCTTCTCCGGGCACCAGCTCTACTGGTTCTCCAGG TTCTAGCCCTTCTGCATCCACCGGTACCGGTCCAGGTA GCTCTACCCCTTCTGGTGCAACCGGCTCTCCA | 542 |
| LCW0404_040_GFP-N_H09.ab1 | GASPGTSSTGSPGSST PSGATGSPGSSTPSGA TGSP | 543 | GGTGCATCCCGGGCACCAGCTCTACCGGTTCTCCAGG TAGCTCTACCCCGTCTGGTGCTACCGGCTCTCCAGGTA GCTCTACCCCGTCTGGTGCTACTGGCTCTCCA | 544 |
| LCW0404_041_GFP-N_A10.ab1 | GTPGSGTASSSPGSST PSGATGSPGTPGSGT ASSSP | 545 | GGTACCCCTGGTAGCGGTACTGCTTCTTCCTCTCCAGG TAGCTCTACTCCGTCTGGTGCTACCGGTTCTCCAGGTA CCCCGGGTAGCGGTACCGCATCTTCTTCTCCA | 546 |
| LCW0404_043_GFP-N_C10.ab1 | GSSPSASTGTGPGSST PSGATGSPGSSTPSGA TGSP | 547 | GGTTCTAGCCCTTCTGCTTCCACCGGTACTGGCCCAGG TAGCTCTACCCCTTCTGGTGCTACCGGCTCCCAGGTA GCTCTACTCCTTCTGGTGCAACTGGCTCTCCA | 548 |
| LCW0404_045_GFP-N_D10.ab1 | GASPGTSSTGSPGSSP SASTGTGPGSSPSAST GTGP | 549 | GGTGCTTCTCCTGGCACCAGCTCTACTGGTTCTCCAGG TTCTAGCCCTTCTGCTTCTACCGGTACTGGTCCAGGTTC TAGCCCTTCTGCATCCACTGGTACTGGTCCA | 550 |

TABLE 11-continued

DNA and Amino Acid Sequences for 36-mer motifs

| File Name | Amino acid sequence | SEQ ID NO: | Nucleotide sequence | SEQ ID NO: |
|---|---|---|---|---|
| LCW0404_047_GFP-N_F10.ab1 | GTPGSGTASSSPGASP GTSSTGSPGASPGTSS TGSP | 551 | GGTACTCCTGGCAGCGGTACCGCTTCTTCTTCTCCAGG TGCTTCTCCTGGTACTAGCTCTACTGGTTCTCCAGGTG CTTCTCCGGGCACTAGCTCTACTGGTTCTCCA | 552 |
| LCW0404_048_GFP-N_G10.ab1 | GSSTPSGATGSPGASP GTSSTGSPGSSTPSGA TGSP | 553 | GGTAGCTCTACCCCGTCTGGTGCTACCGGTTCCCCAGG TGCTTCTCCTGGTACTAGCTCTACCGGTTCTCCAGGTA GCTCTACCCCGTCTGGTGCTACTGGCTCTCCA | 554 |
| LCW0404_049_GFP-N_H10.ab1 | GSSTPSGATGSPGTPG SGTASSSPGSSTPSGA TGSP | 555 | GGTAGCTCTACCCCGTCTGGTGCTACTGGTTCTCCAGG TACTCCGGGCAGCGGTACTGCTTCTTCCTCTCCAGGTA GCTCTACCCCTTCTGGTGCTACTGGCTCTCCA | 556 |
| LCW0404_050_GFP-N_A11.ab1 | GASPGTSSTGSPGSSP SASTGTGPGSSTPSGA TGSP | 557 | GGTGCATCTCCTGGTACCAGCTCTACTGGTTCTCCAGG TTCTAGCCCTTCTGCTTCTACCGGTACCGGTCCAGGTA GCTCTACTCCTTCTGGTGCTACCGGTTCTCCA | 558 |
| LCW0404_051_GFP-N_B11.ab1 | GSSTPSGATGSPGSST PSGATGSPGSSTPSGA TGSP | 559 | GGTAGCTCTACCCCGTCTGGTGCTACTGGCTCTCCAGG TAGCTCTACTCCTTCTGGTGCTACTGGTTCCCCAGGTA GCTCTACCCCGTCTGGTGCAACTGGCTCTCCA | 560 |
| LCW0404_052_GFP-N_C11.ab1 | GASPGTSSTGSPGTPG SGTASSSPGASPGTSS TGSP | 561 | GGTGCATCCCCGGGTACCAGCTCTACCGGTTCTCCAGG TACTCCTGGCAGCGGTACTGCATCTTCCTCTCCAGGTG CTTCTCCGGGCACCAGCTCTACTGGTTCTCCA | 562 |
| LCW0404_053_GFP-N_D11.ab1 | GSSTPSGATGSPGSSP SASTGTGPGASPGTSS TGSP | 563 | GGTAGCTCTACTCCTTCTGGTGCAACTGGTTCTCCAGG TTCTAGCCCGTCTGCATCCACTGGTACCGGTCAGGTA CTTCCCCTGGCACCAGCTCTACCGGTTCTCCA | 564 |
| LCW0404_057_GFP-N_E11.ab1 | GASPGTSSTGSPGSST PSGATGSPGSSPSAST GTGP | 565 | GGTGCATCTCCTGGTACTAGCTCTACTGGTTCTCCAGG TAGCTCTACTCCGTCTGGTGCAACCGGCTCTCCAGGTT CTAGCCCTTCTGCATCTACCGGTACTGGTCCA | 566 |
| LCW0404_060_GFP-N_F11.ab1 | GTPGSGTASSSPGSST PSGATGSPGASPGTSS TGSP | 567 | GGTACTCCTGGCAGCGGTACCGCATCTTCCTCTCCAGG TAGCTCTACTCCGTCTGGTGCAACTGGTTCCCCAGGTG CTTCTCCGGGTACCAGCTCTACCGGTTCTCCA | 568 |
| LCW0404_062_GFP-N_G11.ab1 | GSSTPSGATGSPGTPG SGTASSSPGSSTPSGA TGSP | 569 | GGTAGCTCTACCCCGTCTGGTGCAACCGGCTCCCCAGG TACTCCTGGTAGCGGTACCGCTTCTTCTTCTCCAGGTA GCTCTACTCCGTCTGGTGCTACCGGCTCCCCA | 570 |
| LCW0404_066_GFP-N_H11.ab1 | GSSPSASTGTGPGSSP SASTGTGPGASPGTSS TGSP | 571 | GGTTCTAGCCCTTCTGCATCCACCGGTACCGGCCCAGG TTCTAGCCCGTCTGCTTCTACCGGTACTGGTCCAGGTG CTTCTCCGGGTACTAGCTCTACTGGTTCTCCA | 572 |
| LCW0404_067_GFP-N_A12.ab1 | GTPGSGTASSSPGSST PSGATGSPGSNPSAST GTGP | 573 | GGTACCCCGGGTAGCGGTACCGCTTCTTCTTCTCCAGG TAGCTCTACTCCGTCTGGTGCTACCGGCTCTCCAGGTT CTAACCCTTCTGCATCCACCGGTACCGGCCCA | 574 |
| LCW0404_068_GFP-N_B12.ab1 | GSSPSASTGTGPGSST PSGATGSPGASPGTSS TGSP | 575 | GGTTCTAGCCCTTCTGCATCTACTGGTACTGGCCCAGG TAGCTCTACTCCTTCTGGTGCTACCGGCTCTCCAGGTG CTTCTCCGGGTACTAGCTCTACCGGTTCTCCA | 576 |
| LCW0404_069_GFP-N_C12.ab1 | GSSTPSGATGSPGASP GTSSTGSPGTPGSGTA SSSP | 577 | GGTAGCTCTACCCCTTCTGGTGCAACCGGCTCTCCAGG TGCATCCCCGGGTACCAGCTCTACCGGTTCTCCAGGTA CTCCGGGTAGCGGTACCGCTTCTTCCTCTCCA | 578 |
| LCW0404_070_GFP-N_D12.ab1 | GSSTPSGATGSPGSST PSGATGSPGSSTPSGA TGSP | 579 | GGTAGCTCTACTCCGTCTGGTGCAACCGGTTCCCCAGG TAGCTCTACCCCTTCTGGTGCAACCGGCTCCCCAGGTA GCTCTACCCCTTCTGGTGCAACTGGCTCTCCA | 580 |
| LCW0404_073_GFP-N_E12.ab1 | GASPGTSSTGSPGTPG SGTASSSPGSSTPSGA TGSP | 581 | GGTGCTTCTCCTGGCACTAGCTCTACCGGTTCTCCAGG TACCCCTGGTAGCGGTACCGCATCTTCCTCTCCAGGTA GCTCTACCCCTTCTGGTGCTACTGGTTCCCCA | 582 |
| LCW0404_075_GFP-N_F12.ab1 | GSSTPSGATGSPGSSP SASTGTGPGSSPSAST GTGP | 583 | GGTAGCTCTACCCCGTCTGGTGCTACTGGCTCCCCAGG TTCTAGCCCTTCTGCATCCACCGGTACCGGTCAGGTT CTAGCCCGTCTGCATCTACTGGTACTGGTCCA | 584 |
| LCW0404_080_GFP-N_G12.ab1 | GASPGTSSTGSPGSSP SASTGTGPGSSPSAST GTGP | 585 | GGTGCTTCCCCGGGCACCAGCTCTACTGGTTCTCCAGG TTCTAGCCCGTCTGCTTCTACTGGTACTGGTCCAGGTT CTAGCCCTTCTGCTTCCACTGGTACTGGTCCA | 586 |

TABLE 11-continued

DNA and Amino Acid Sequences for 36-mer motifs

| File Name | Amino acid sequence | SEQ ID NO: | Nucleotide sequence | SEQ ID NO: |
|---|---|---|---|---|
| LCW0404_081_GFP-N_H12.ab1 | GASPGTSSTGSPGSSP SASTGTGPGTPGSGT ASSSP | 587 | GGTGCTTCCCCGGGTACCAGCTCTACCGGTTCTCCAGG TTCTAGCCCTTCTGCTTCTACCGGTACCGGTCCAGGTA CCCCTGGCAGCGGTACCGCATCTTCCTCTCCA | 588 |

Example 5

Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of *E. coli* harboring all 37 different 36-amino acid segments were mixed and plasmids were isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6

Construction of XTEN_AM144

A collection of XTEN_AM144 segments was constructed starting from 37 different segments of XTEN_AE36, 44 segments of XTEN_AF36, and 44 segments of XTEN_AG36.

Cultures of *E. coli* harboring all 125 different 36-amino acid segments were mixed and plasmids were isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm 192 isolates showed high level expression and were submitted to DNA sequencing. Most clones in library LCW0462 showed good expression and similar physicochemical properties suggesting that most combinations of XTEN_AM36 segments yield useful XTEN sequences. 30 isolates from LCW0462 were chosen as a preferred collection of XTEN_AM144 segments for the construction of multifunctional proteins that contain multiple XTEN segments. The file names of the nucleotide and amino acid constructs for these segments are listed in Table 12.

TABLE 12

DNA and amino acid sequences for AM144 segments

| Clone | DNA Sequence | SEQ ID NO: | Protein Sequence | SEQ ID NO: |
|---|---|---|---|---|
| LCW462_r1 | GGTACCCCGGGCAGCGGTACCGCATCTTCCTCTCCAGGTA GCTCTACCCCGTCTGGTGCTACCGGTTCCCCAGGTAGCTC TACCCCGTCTGGTGCAACCGGCTCCCCAGGTAGCCCGGCT GGCTCTCCTACCTCTACTGAGGAAGGTACTTCTGAAAGCG CTACTCCTGAGTCTGGTCCAGGTACCTCTACTGAACCGTC CGAAGGTAGCGCTCCAGGTTCTAGCCCTTCTGCATCCACC GGTACCGGCCCAGGTTCTAGCCCGTCTGCTTCTACCGGTA CTGGTCCAGGTGCTTCTCCGGGTACTAGCTCTACTGGTTC TCCAGGTACCTCTACCGAACCGTCCGAGGGTAGCGCACC AGGTACCTCTACTGAACCGTCTGAGGGTAGCGCTCCAGG TAGCGAACCGGCAACCTCCGGTTCTGAAACTCCA | 589 | GTPGSGTASSSPGS STPSGATGSPGSSTP SGATGSPGSPAGSP TSTEEGTSESATPES GPGTSTEPSEGSAP GSSPSASTGTGPGS SPSASTGTGPGASP GTSSTGSPGTSTEPS EGSAPGTSTEPSEG SAPGSEPATSGSETP | 590 |

TABLE 12-continued

DNA and amino acid sequences for AM144 segments

| Clone | DNA Sequence | SEQ ID NO: | Protein Sequence | SEQ ID NO: |
|---|---|---|---|---|
| LCW462_r5 | GGTTCTACCAGCGAATCCCCTTCTGGCACTGCACCAGGTT CTACTAGCGAATCCCCTTCTGGTACCGCACCAGGTACTTC TCCGAGCGGCGAATCTTCTACTGCTCCAGGTACCTCTACT GAACCTTCCGAAGGCAGCGCTCCAGGTACCTCTACCGAA CCGTCCGAGGGCAGCGCACCAGGTACTTCTGAAAGCGCA ACCCCTGAATCCGGTCCAGGTGCATCTCCTGGTACCAGCT CTACCGGTTCTCCAGGTAGCTCTACTCCTTCTGGTGCTAC TGGCTCTCCAGGTGCTTCCCCGGGTACCAGCTCTACCGGT TCTCCAGGTTCTACTAGCGAATCTCCTTCTGGCACTGCAC CAGGTTCTACCAGCGAATCTCCGTCTGGCACTGCACCAGG TACCTCTACCCCTGAAAGCGGTTCCGCTTCTCCA | 591 | GSTSESPSGTAPGST SESPSGTAPGTSPSG ESSTAPGTSTEPSEG SAPGTSTEPSEGSAP GTSESATPESGPGA SPGTSSTGSPGSSTP SGATGSPGASPGTS STGSPGSTSESPSGT APGSTSESPSGTAP GTSTPESGSASP | 592 |
| LCW462_r9 | GGTACTTCTACCGAACCTTCCGAGGGCAGCGCACCAGGT ACTTCTGAAAGCGCTACCCCTGAGTCCGGCCCAGGTACTT CTGAAAGCGCTACTCCTGAATCCGGTCCAGGTACCTCTAC TGAACCTTCTGAGGGCAGCGCTCCAGGTACTTCTGAAAG CGCTACCCCGGAGTCCGGTCCAGGTACTTCTACTGAACCG TCCGAAGGTAGCGCACCAGGTACTTCTACTGAACCTTCCG AAGGTAGCGCTCCAGGTAGCGAACCTGCTACTTCTGGTTC TGAAACCCCAGGTAGCCCGGCTGGCTCTCCGACCTCCACC GAGGAAGGTGCTTCTCCTGGCACCAGCTCTACTGGTTCTC AGGTTCTAGCCCTTCTGCTTCTACCGGTACTGGTCCAGG TTCTAGCCCTTCTGCATCCACTGGTACTGGTCCA | 593 | GTSTEPSEGSAPGT SESATPESGPGTSES ATPESGPGTSTEPSE GSAPGTSESATPES GPGTSTEPSEGSAP GTSTEPSEGSAPGS EPATSGSETPGSPA GSPTSTEEGASPGT SSTGSPGSSPSASTG TGPGSSPSASTGTGP | 594 |
| LCW462_r10 | GGTAGCGAACCGGCAACCTCTGGCTCTGAAACCCCAGGT ACCTCTGAAAGCGCTACTCCGGAATCTGGTCCAGGTACTT CTGAAAGCGCTACTCCGGAATCCGGTCCAGGTTCTACCA GCGAATCTCCTTCTGGCACCGCTCCAGGTTCTACTAGCGA ATCCCCGTCTGGTACCGCACCAGGTACTTCTCCTAGCGGC GAATCTTCTACCGCACCAGGTGCATCTCCGGGTACTAGCT CTACCGGTTCTCCAGGTTCTAGCCCTTCTGCTTCTCACTGGT ACCGGCCCAGGTAGCTCTACCCCGTCTGGTGCTACTGGTT CCCCAGGTAGCTCTACTCCGTCTGGTGCAACCGGTTCCC AGGTAGCTCTACTCCTTCTGGTGCTACTGGCTCCCCAGGT GCATCCCCTGGCACCAGCTCTACCGGTTCTCCA | 595 | GSEPATSGSETPGT SESATPESGPGTSES ATPESGPGTSTESPS GTAPGSTSESPSGT APGSTSPSGESSTAP GASPGTSSTGSPGS SPSASTGTGPGSSTP SGATGSPGSSTPSG ATGSPGSSTPSGAT GSPGASPGTSSTGSP | 596 |
| LCW462_r15 | GGTGCTTCTCCGGGCACCAGCTCTACTGGTTCTCCAGGTT CTAGCCCTTCTGCATCCACCGGTACCGGTCCAGGTAGCTC TACCCCTTCTGGTGCAACCGGCTCTCCAGGTACTTCTGAA AGCGCTACCCCGGAATCTGGCCCAGGTAGCGAACCGGCT ACTTCTGGTTCTGAAACCCCAGGTAGCGAACCGGCTACCT CCGGTTCTGAAACTCCAGGTACTTCTGAAAGCGCTACTCC GGAGTCCGGTCCAGGTACCTCTACCGAACCGTCCGAAGG CAGCGCTCCAGGTACTTCTACTGAACCTTCTGAGGGTAGC GCTCCAGGTACCTCTACCGAACCGTCCGAGGGTAGCGCA CCAGGTACCTCTACTGAACCGTCTGAGGGTAGCGCTCCA GGTAGCGAACCGGCAACCTCCGGTTCTGAAACTCCA | 597 | GASPGTSSTGSPGS SPSASTGTGPGSSTP SGATGSPGTSESAT PESGPGSEPATSGSE TPGSEPATSGSETP GTSESATPESGPGT STEPSEGSAPGTSTE PSEGSAPGTSTEPSE GSAPGTSTEPSEGS APGSEPATSGSETP | 598 |
| LCW462_r16 | GGTACCTCTACCGAACCTTCCGAAGGTAGCGCTCCAGGT AGCCCGGCAGGTTCTCCTACTTCCACTGAGGAAGGTACTT CTACCGAACCTTCTGAGGGTAGCGCACCAGGTACCTCTG AAAGCGCAACTCCTGAGTCTGGCCCAGGTAGCGAACCTG CTACCTCCGGCTCTGAGACTCCAGGTACCTCTGAAAGCGC AACCCCGGAATCTGGTCCAGGTAGCCCGGCTGGCTCTCCT ACCTCTACTGAGGAAGGTACTTCTGAAAGCGCTACTCCTG AGTCTGGTCCAGGTACCTCTACTGAACGTCCGAAGGTA GCGCTCCAGGTAGCGAACCTGCTACTTCTGGTTCTGAAAC TCCAGGTACTTCTACCGAACGTCCGAGGGTAGCGCTCCA GGTAGCGAACCTGCTACTTCTGGTTCTGAAACTCCA | 599 | GTSTEPSEGSAPGSP AGSPTSTEEGTSTEP SEGSAPGTSESATP ESGPGSEPATSGSE TPGTSESATPESGP GSPAGSPTSTEEGT SESATPESGPGTSTE PSEGSAPGSEPATS GSETPGTSTEPSEGS APGSEPATSGSETP | 600 |
| LCW462_r20 | GGTACTTCTACCGAACCGTCCGAAGGCAGCGCTCCAGGT ACCTCTACTGAACCTTCCGAGGGCAGCGCTCCAGGTACCT CTACCGAACCTTCTGAAGGTAGCGCACCAGGTACTTCTAC CGAACCGTCCGAAGGCAGCGCTCCAGGTACCTCTACTGA ACCTTCCGAGGGCAGCGCTCCAGGTACCTCTACCGAACCT TCTGAAGGTAGCGCACCAGGTACTTCTACCGAACCTTCCG AGGGCAGCGCACCAGGTACTTCTGAAAGCGCTACCCCTG AGTCCGGCCCAGGTACTTCTGAAAGCGCTACTCCTGAATC CGGTCCAGGTACTTCTACTGAACCTTCCGAAGGTAGCGCT CCAGGTAGCGAACCTGCTACTTCTGGTTCTGAAACCCCAG GTAGCCCGGCTGGCTCTCCGACCTCCACCGAGGAA | 601 | GTSTEPSEGSAPGT STEPSEGSAPGTSTE PSEGSAPGTSTEPSE GSAPGTSTEPSEGS APGTSTEPSEGSAP GTSESATPESGPGT SESATPESGPGTSES ATPESGPGTSTEPSE GSAPGSEPATSGSE TPGSPAGSPTSTEE | 602 |

TABLE 12-continued

DNA and amino acid sequences for AM144 segments

| Clone | DNA Sequence | SEQ ID NO: | Protein Sequence | SEQ ID NO: |
|---|---|---|---|---|
| LCW462_r23 | GGTACTTCTACCGAACCGTCCGAGGGCAGCGCTCCAGGT ACTTCTACTGAACCTTCTGAAGGCAGCGCTCCAGGTACTT CTACTGAACCTTCCGAAGGTAGCGCACCAGGTTCTACCA GCGAATCCCCTTCTGGTACTGCTCCAGGTTCTACCAGCGA ATCCCCTTCTGGCACCGCACCAGGTACTTCTACCCCTGAA AGCGGCTCCGCTTCTCCAGGTAGCGAACCTGCAACCTCTG GCTCTGAAACCCCAGGTACCTCTGAAAGCGGTACTCCTGA ATCTGGCCCAGGTACTTCTACTGAACCGTCCGAGGGCAG CGCACCAGGTACTTCTACTGAACCGTCTGAAGGTAGCGC ACCAGGTACTTCTGAAAGCGCAACCCCGGAATCCGGCCC AGGTACCTCTGAAAGCGCAACCCCGGAGTCCGGCCCA | 603 | GTSTEPSEGSAPGT STEPSEGSAPGTSTE PSEGSAPGSTSESPS GTAPGSTSESPSGT APGTSTPESGSASP GSEPATSGSETPGT SESATPESGPGTSTE PSEGSAPGTSTEPSE GSAPGTSESATPES GPGTSESATPESGP | 604 |
| LCW462_r24 | GGTAGCTCTACCCCTTCTGGTGCTACCGGCTCTCCAGGTT CTAGCCCGTCTGCTTCTACCGGTACCGGTCCAGGTAGCTC TACCCCTTCTGGTGCTACTGGTTCTCCAGGTAGCCCTGCT GGCTCTCCGACTTCTACTGAGGAAGGTAGCCCGGCTGGTT CTCCGACTTCTACTGAGGAAGGTACTTCTACCGAACCTTC CGAAGGTAGCGCTCCAGGTGCTTCCCCGGGCACTAGCTCT ACCGGTTCTCCAGGTTCTAGCCCTTCTGCATCTACTGGTA CTGGCCCAGGTACTCCGGGCAGCGGTACTGCTTCTTCCTC TCCAGGTTCTACTAGCTCTACTGCTGAATCTCCTGGCCCA GGTACTTCTCCTAGCGGTGAATCTTCTACCGCTCCAGGTA CCTCTACTCCGGAAAGCGGTTCTGCATCTCCA | 605 | GSSTPSGATGSPGS SPSASTGTGPGSSTP SGATGSPGSPAGSP TSTEEGSPAGSPTST EEGTSTEPSEGSAP GASPGTSSTGSPGS SPSASTGTGPGTPG SGTASSSPGSTSSTA ESPGPGTSPSGESST APGTSTPESGSASP | 606 |
| LCW462_r27 | GGTACCTCTACTGAACCTTCTGAGGGCAGCGCTCCAGGTA CTTCTGAAAGCGCTACCCCGGAGTCCGGTCCAGGTACTTC TACTGAACCGTCCGAAGGTAGCGCACCAGGTACTTCTACT GAACCGTCTGAAGGTAGCGCACCAGGTACTTCTGAAAGC GCAACCCCGGAATCCGGCCCAGGTACCTCTGAAAGCGCA ACCCCGGAGTCCGGCCCAGGTACTCCTGGCAGCGGTACC GCTTCTTCTTCTCCAGGTGCTTCTCCTGGTACTAGCTCTAC TGGTTCTCCAGGTGCTTCTCCGGGCACTAGCTCTACTGGT TCTCCAGGTAGCCCTGCTGGCTCTCCGACTTCTACTGAGG AAGGTAGCCCGGCTGGTTCTCCGACTTCTACTGAGGAAG GTACTTCTACCGAACCTTCCGAAGGTAGCGCTCCA | 607 | GTSTEPSEGSAPGT SESATPESGPGTSTE PSEGSAPGTSTEPSE GSAPGTSESATPES GPGTSESATPESGP GTPGSGTASSSPGA SPGTSSTGSPGASP GTSSTGSPGSPAGS PTSTEEGSPAGSPTS TEEGTSTEPSEGSAP | 608 |
| LCW462_r28 | GGTAGCCCAGCAGGCTCTCCGACTTCCACTGAGGAAGGT ACTTCTACTGAACCTTCCGAAGGCAGCGCACCAGGTACCT CTACTGAACCTTCTGAGGGCAGCGCTCCAGGTACCTCTAC CGAACCGTCTGAAGGTAGCGCACCAGGTACTTCTGAAAG CGCAACTCCTGAGTCCGGTCCAGGTACTTCTGAAAGCGC AACCCCGGAGTCTGGCCCAGGTACCCCGGGTAGCGGTAC TGCTTCTTCCTCTCCAGGTAGCTCTACCCCTTCTGGTGCAA CCGGCTCTCCAGGTGCTTCTCCGGGCACCAGCTCTACCGG TTCTCCAGGTACCTCTACTGAACCTTCTGAGGGCAGCGCT CCAGGTACTTCTGAAAGCGCTACCCCGGAGTCCGGTCCA GGTACTTCTACTGAACCGTCCGAAGGTAGCGCACCA | 609 | GSPAGSPTSTEEGT STEPSEGSAPGTSTE PSEGSAPGTSTEPSE GSAPGTSESATPES GPGTSESATPESGP GTPGSGTASSSPGS STPSGATGSPGASP GTSSTGSPGTSTEPS EGSAPGTSESATPE SGPGTSTEPSEGSAP | 610 |
| LCW462_r38 | GGTAGCGAACCGGCAACCTCCGGCTCTGAAACTCCAGGT ACTTCTGAAAGCGCTACTCCGGAATCCGGCCCAGGTAGC GAACCGGCTACTTCCGGCTCTGAAACCCCAGGTAGCTCTA CCCCGTCTGGTGCAACCGGCTCCCCAGGTACTCCTGGTAG CGGTACCGCTTCTTCTTCTCCAGGTAGCTCTACTCCGTCTG GTGCTACCGGCTCCCCAGGTGCATCTCCTGGTACCAGCTC TACCGGTTCTCCAGGTAGCTCTACTCCTTCTGGTGCTACT GGCTCTCCAGGTGCTTCCCCGGGTACCAGCTCTACCGGTT CTCCAGGTAGCGAACCTGCTACTTCTGGTTCTGAAACTCC AGGTACTTCTACCGAACCGTCCGAGGGTAGCGCTCCAGG TAGCGAACCTGCTACTTCTGGTTCTGAAACTCCA | 611 | GSEPATSGSETPGT SESATPESGPGSEPA TSGSETPGSSTPSGA TGSPGTPGSGTASS SPGSSTPSGATGSP GASPGTSSTGSPGS STPSGATGSPGASP GTSSTGSPGSEPATS GSETPGTSTEPSEGS APGSEPATSGSETP | 612 |
| LCW462_r39 | GGTACCTCTACTGAACCTTCCGAAGGCAGCGCTCCAGGT ACCTCTACCGAACCGTCCGAGGGCAGCGCACCAGGTACT TCTGAAAGCGCAACCCCTGAATCCGGTCCAGGTAGCCCT GCTGGCTCTCCGACTTCTACTGAGGAAGGTAGCCCGGCTG GTTCTCCGACTTCTACTGAGGAAGGTACTTCTACCGAACC TTCCGAAGGTAGCGCTCCAGGTAGCCCGGCTGGTTCTCCG ACTTCCACCGAGGAAGGTACCTCTACTGAACCTTCTGAGG GTAGCGCTCCAGGTACCTCTACTGAACCTTCCGAAGGCA GCGCTCCAGGTGCTTCCCCGGGCACCAGCTCTACTGGTTC TCCAGGTTCTAGCCCGTCTGCTTCTACTGGTACTGGTCCA GGTTCTAGCCCTTCTGCTTCCACTGGTACTGGTCCA | 613 | GTSTEPSEGSAPGT STEPSEGSAPGTSES ATPESGPGSPAGSP TSTEEGSPAGSPTST EEGTSTEPSEGSAP GSPAGSPTSTEEGT STEPSEGSAPGTSTE PSEGSAPGASPGTS STGSPGSSPSASTGT GPGSSPSASTGTGP | 614 |

TABLE 12-continued

DNA and amino acid sequences for AM144 segments

| Clone | DNA Sequence | SEQ ID NO: | Protein Sequence | SEQ ID NO: |
|---|---|---|---|---|
| LCW462_r41 | GGTAGCTCTACCCCGTCTGGTGCTACCGGTTCCCCAGGTG CTTCTCCTGGTACTAGCTCTACCGGTTCTCCAGGTAGCTC TACCCCGTCTGGTGCTACTGGCTCTCCAGGTAGCCCTGCT GGCTCTCCAACCTCCACCGAAGAAGGTACCTCTGAAAGC GCAACCCCTGAATCCGGCCCAGGTAGCGAACCGGCAACC TCCGGTTCTGAAACCCCAGGTGCATCTCCTGGTACTAGCT CTACTGGTTCTCCAGGTAGCTCTACTCCGTCTGGTGCAAC CGGCTCTCCAGGTTCTAGCCCTTCTGCATCTACCGGTACT GGTCCAGGTTCTACCAGCGAATCCCCTTCTGGTACTGCTC CAGGTTCTACCAGCGAATCCCCTTCTGGCACCGCACCAGG TACTTCTACCCCTGAAAGCGGCTCCGCTTCTCCA | 615 | GSSTPSGATGSPGA SPGTSSTGSPGSSTP SGATGSPGSPAGSP TSTEEGTSESATPES GPGSEPATSGSETP GASPGTSSTGSPGS STPSGATGSPGSSPS ASTGTGPGSTSESPS GTAPGSTSESPSGT APGTSTPESGSASP | 616 |
| LCW462_r42 | GGTTCTACCAGCGAATCTCCTTCTGGCACCGCTCCAGGTT CTACTAGCGAATCCCCGTCTGGTACCGCACCAGGTACTTC TCCTAGCGGCGAATCTTCTACCGCACCAGGTACCTCTGAA AGCGCTACTCCGGAGTCTGGCCCAGGTACCTCTACTGAAC CGTCTGAGGGTAGCGCTCCAGGTACTTCTACTGAACCGTC CGAAGGTAGCGCACCAGGTACCTCTACTGAACCTTCTGA GGGCAGCGCTCCAGGTACTTCTGAAAGCGCTACCCCGGA GTCCGGTCCAGGTACTTCTACTGAACCGTCCGAAGGTAGC GCACCAGGTAGCTCTACCCCGTCTGGTGCTACCGGTTCCC CAGGTGCTTCTCCTGGTACTAGCTCTACCGGTTCTCCAGG TAGCTCTACCCCGTCTGGTGCTACTGGCTCTCCA | 617 | GSTSESPSGTAPGST SESPSGTAPGTSPSG ESSTAPGTSESATPE SGPGTSTEPSEGSAP GTSTEPSEGSAPGT STEPSEGSAPGTSES ATPESGPGTSTEPSE GSAPGSSTPSGATG SPGASPGTSSTGSP GSSTPSGATGSP | 618 |
| LCW462_r43 | GGTTCTACTAGCTCTACTGCAGAATCTCCGGGCCCAGGTA CCTCTCCTAGCGGTGAATCTTCTACCGCTCCAGGTACTTC TCCGAGCGGTGAATCTTCTACCGCTCCAGGTTCTACTAGC TCTACCGCTGAATCTCCGGGTCCAGGTTCTACCAGCTCTA CTGCAGAATCTCCTGGCCCAGGTACTTCTACTCCGGAAAG CGGTTCCGCTTCTCCAGGTACTTCTCCTAGCGGTGAATCT TCTACCGCTCCAGGTTCTACCAGCTCTACTGCTGAATCTC CTGGCCCAGGTACTTCTACCCCGGAAAGCGGTTCCGCTTC TCCAGGTTCTACCAGCTCTACCGCTGAATCTCCTGGCCCA GGTTCTACTAGCGAATCTCCGTCTGGCACCGCACCAGGTA CTTCCCCTAGCGGTGAATCTTCTACTGCACCA | 619 | GSTSSTAESPGPGTS PSGESSTAPGTSPSG ESSTAPGTSSTAES PGPGTSSTAESPGP GTSTPESGSASPGTS PSGESSTAPGSTSST AESPGPGTSTPESGS ASPGSTSSTAESPGP GSTSESPSGTAPGTS PSGESSTAP | 620 |
| LCW462_r45 | GGTACCTCTACTCCGGAAAGCGGTTCCGCATCTCCAGGTT CTACCAGCGAATCCCCGTCTGGCACCGCACCAGGTTCTAC TAGCTCTACTGCTGAATCTCCGGGCCCAGGTACCTCTACT GAACCTTCCGAAGGCAGCGCTCCAGGTACCTCTACCGAA CCGTCCGAGGGCAGCGCACCAGGTACTTCTGAAAGCGCA ACCCCTGAATCCGGTCCAGGTACCTCTGAAAGCGCTACTC CGGAGTCTGGCCCAGGTACCTCTACTGAACCGTCTGAGG GTAGCGCTCCAGGTACTTCTACTGAACCGTCCGAAGGTA GCGCACCAGGTACTTCTGAAAGCGCTACTCCGGAGTCCG GTCCAGGTACCTCTACCGAACCGTCCGAAGGCAGCGCTC CAGGTACTTCTACTGAACCTTCTGAGGGTAGCGCTCCC | 621 | GTSTPESGSASPGST SESPSGTAPGSTSST AESPGPGTSTEPSE GSAPGTSTEPSEGS APGTSESATPESGP GTSESATPESGPGT STEPSEGSAPGTSTE PSEGSAPGTSESATP ESGPGTSTEPSEGS APGTSTEPSEGSAP | 622 |
| LCW462_r47 | GGTACCTCTACCGAACCGTCCGAGGGTAGCGCACCAGGT ACCTCTACTGAACCGTCTGAGGGTAGCGCTCCAGGTAGC GAACCGGCAACCTCCGGTTCTGAAACTCCAGGTACTTCTA CTGAACCGTCTGAAGGTAGCGCACCAGGTACTTCTGAAA GCGCAACCCCGGAATCCGGCCCAGGTACCTCTGAAAGCG CAACCCCGGAGTCCGGCCCAGGTGCATCTCCGGGTACTA GCTCTACCGGTTCTCCAGGTTCTAGCCCTTCTGCTTCCACT GGTACCGGCCCAGGTAGCTCTACCCCGTCTGGTGCTACTG GTTCCCCAGGTAGCTCTACTCCGTCTGGTGCAACCGGTTC CCCAGGTAGCTCTACTCCTTCTGGTGCTACTGGCTCCCCA GGTGCATCCCTGGCACCAGCTCTACCGGTTCTCCA | 623 | GTSTEPSEGSAPGT STEPSEGSAPGSEPA TSGSETPGTSTEPSE GSAPGTSESATPES GPGTSESATPESGP GASPGTSSTGSPGS SPSASTGTGPGSSTP SGATGSPGSSTPSG ATGSPGSSTPSGAT GSPGASPGTSSTGSP | 624 |
| LCW462_r54 | GGTAGCGAACCGGCAACCTCTGGCTCTGAAACTCCAGGT AGCGAACCTGCAACCTCCGGCTCTGAAACCCCAGGTACT TCTACTGAACCTTCTGAGGGCAGCGCACCAGGTAGCGAA CCTGCAACCTCTGGCTCTGAAACCCCAGGTACCTCTGAAA GCGCTACTCCTGAATCTGGCCCAGGTACTTCTACTGAACC GTCCGAGGGCAGCGCACCAGGTAGCTCTACTCCGTCTGG TGCTACCGGCTCTCCAGGTAGCTCTACCCCTTCTGGTGCA ACCGGCTCTCCAGGTGCTTCTCCGGGTACCAGCTCTACTG GTTCTCCAGGTAGCTCTACCCCGTCTGGTGCTACCGGTTC CCCAGGTGCTTCTCCTGGTACTAGCTCTACCGGTTCTCCA GGTAGCTCTACCCCGTCTGGTGCTACTGGCTCTCCA | 625 | GSEPATSGSETPGS EPATSGSETPGTSTE PSEGSAPGSEPATS GSETPGTSESATPES GPGTSTEPSEGSAP GSSTPSGATGSPGS STPSGATGSPGASP GTSSTGSPGSSTPSG ATGSPGASPGTSST GSPGSSTPSGATGSP | 626 |

TABLE 12-continued

DNA and amino acid sequences for AM144 segments

| Clone | DNA Sequence | SEQ ID NO: | Protein Sequence | SEQ ID NO: |
|---|---|---|---|---|
| LCW462_r55 | GGTACTTCTACCGAACCGTCCGAGGGCAGCGCTCCAGGT ACTTCTACTGAACCTTCTGAAGGCAGCGCTCCAGGTACTT CTACTGAACCTTCCGAAGGTAGCGCACCAGGTACTTCTGA AAGCGCTACTCCGGAGTCCGGTCCAGGTACCTCTACCGA ACCGTCCGAAGGCAGCGCTCCAGGTACTTCTACTGAACCT TCTGAGGGTAGCGCTCCAGGTTCTACTAGCGAATCTCCGT CTGGCACTGCTCCAGGTACTTCTCCTAGCGGTGAATCTTC TACCGCTCCAGGTACTTCCCCTAGCGGCGAATCTTCTACC GCTCCAGGTAGCCCGGCTGGCTCTCCTACCTCTACTGAGG AAGGTACTTCTGAAAGCGCTACTCCTGAGTCTGGTCCAGG TACCTCTACTGAACCGTCCGAAGGTAGCGCTCCA | 627 | GTSTEPSEGSAPGT STEPSEGSAPGTSTE PSEGSAPGTSESATP ESGPGTSTEPSEGS APGTSTEPSEGSAP GSTSESPSGTAPGTS PSGESSTAPGTSPSG ESSTAPGSPAGSPTS TEEGTSESATPESGP GTSTEPSEGSAP | 628 |
| LCW462_r57 | GGTACTTCTACTGAACCTTCCGAAGGTAGCGCTCCAGGTA GCGAACCTGCTACTTCTGGTTCTGAAACCCCAGGTAGCCC GGCTGGCTCTCCGACCTCCACCGAGGAAGGTAGCCCGGC AGGCTCTCCGACCTCTACTGAGGAAGGTACTTCTGAAAG CGCAACCCCGGAGTCCGGCCCAGGTACCTCTACCGAACC GTCTGAGGGCAGCGCACCAGGTACCTCTACTGAACCTTCC GAAGGCAGCGCTCCAGGTACCTCTACCGAACCGTCCGAG GGCAGCGCACCAGGTACTTCTGAAAGCGCAACCCCTGAA TCCGGTCCAGGTAGCTCTACTCCGTCTGGTGCAACCGGCT CCCCAGGTTCTAGCCCGTCTGCTTCCACTGGTACTGGCCC AGGTGCTTCCCCGGGCACCAGCTCTACTGGTTCTCCA | 629 | GTSTEPSEGSAPGS EPATSGSETPGSPA GSPTSTEEGSPAGSP TSTEEGTSESATPES GPGTSTEPSEGSAP GTSTEPSEGSAPGT STEPSEGSAPGTSES ATPESGPGSSTPSG ATGSPGSSPSASTG TGPGASPGTSSTGSP | 630 |
| LCW462_r61 | GGTAGCGAACCGGCTACTTCCGGCTCTGAGACTCCAGGT AGCCCTGCTGGCTCTCCGACCTCTACCGAAGAAGGTACCT CTGAAAGCGCTACCCCTGAGTCTGGCCCAGGTACCTCTAC TGAACCTTCCGAAGGCAGCGCTCCAGGTACCTCTACCGA ACCGTCCGAGGGCAGCGCACCAGGTACTTCTGAAAGCGC AACCCCTGAATCCGGTCCAGGTACCTCTACTCCGGAAAG CGGTTCCGCATCTCCAGGTTCTACCAGCGAATCCCCGTCT GGCACCGCACCAGGTTCTACTAGCTCTACTGCTGAATCTC CGGGCCCAGGTACTTCTGAAAGCGCTACTCCGGAGTCCG GTCCAGGTACCTCTACCGAACCGTCCGAAGGCAGCGCTC CAGGTACTTCTACTGAACCTTCTGAGGGTAGCGCTCCA | 631 | GSEPATSGSETPGSP AGSPTSTEEGTSES ATPESGPGTSTEPSE GSAPGTSTEPSEGS APGTSESATPESGP GTSTPESGSASPGST SESPSGTAPGSTSST AESPGPGTSESATP ESGPGTSTEPSEGS APGTSTEPSEGSAP | 632 |
| LCW462_r64 | GGTACTTCTACCGAACCGTCCGAGGGCAGCGCTCCAGGT ACTTCTACTGAACCTTCTGAAGGCAGCGCTCCAGGTACTT CTACTGAACCTTCCGAAGGTAGCGCACCAGGTACCTCTAC CGAACCGTCTGAAGGTAGCGCACCAGGTACTTCTGAAAG CGCAACTCCTGAGTCCGGTCCAGGTACTTCTGAAAGCGC AACCCCGGAGTCTGGCCCAGGTACTCCTGGCAGCGGTAC CGCATCTTCCTCTCCAGGTAGCTCTACTCCGTCTGGTGCA ACTGGTTCCCAGGTGCTTCTCGGGTACCAGCTCTACCG GTTCTCCAGGTTCCACCAGCTCTACTGCTGAATCTCCTGG TCCAGGTACCTCTCCTAGCGGTGAATCTTCTACTGCTCCA GGTACTTCTACCTGAAAGCGGCTCTGCTTCTCCA | 633 | GTSTEPSEGSAPGT STEPSEGSAPGTSTE PSEGSAPGTSTEPSE GSAPGTSESATPES GPGTSESATPESGP GTPGSGTASSSPGS STPSGATGSPGASP GTSSTGSPGSTSSTA ESPGPGTSPSGESST APGTSTPESGSASP | 634 |
| LCW462_r67 | GGTAGCCCGGCAGGCTCTCCGACCTCTACTGAGGAAGGT ACTTCTGAAAGCGCAACCCCGGAGTCCGGCCCAGGTACC TCTACCGAACCGTCTGAGGCAGCGCACCAGGTACTTCT GAAAGCGCAACCCCTGAATCCGGTCCAGGTAGCGAACCG GCTACTTCTGGCTCTGAGACTCCAGGTACTTCTACCGAAC CGTCCGAAGGTAGCGCACCAGGTAGCCCGGCTGGTTCTC CGACTTCCACCGAGGAAGGTACCTCTACTGAACCTTCTGA GGGTAGCGCTCCAGGTACCTCTACTGAACCTTCCGAAGG CAGCGCTCCAGGTACTTCTACCGAACCGTCCGAGGGCAG CGCTCCAGGTACTTCTACTGAACCTTCGAAGGCAGCGCT CCAGGTACTTCTACTGAACCTTCCGAAGGTAGCGCACCA | 635 | GSPAGSPTSTEEGT SESATPESGPGTSTE PSEGSAPGTSESATP ESGPGSEPATSGSE TPGTSTEPSEGSAP GSPAGSPTSTEEGT STEPSEGSAPGTSTE PSEGSAPGTSTEPSE GSAPGTSTEPSEGS APGTSTEPSEGSAP | 636 |
| LCW462_r69 | GGTACTTCTCCGAGCGGTGAATCTTCTACCGCACCAGGTT CTACTAGCTCTACCGCTGAATCTCCGGGCCCAGGTACTTC TCCGAGCGGTGAATCTTCTACTGCTCCAGGTACCTCTGAA AGCGCTACTCCGGAGTCTGGCCCAGGTACCTCTACTGAAC CGTCTGAGGGTAGCGCTCCAGGTACTTCTACTGAACCGTC CGAAGGTAGCGCACCAGGTTCTAGCCCTTCTGCATCTACT GGTACTGGCCCAGGTAGCTCTACTCCTTCTGGTGCTACCG GCTCTCCAGGTGCTTCTCCGGGTACTAGCTCTACCGGTTC TCCAGGTACTTCTACTCCGGAAAGCGGTTCCGCATCTCCA GGTACTTCTCCTAGCGGTGAATCTTCTACTGCTCCAGGTA CCTCTCCTAGCGGCGAATCTTCTACTGCTCCA | 637 | GTSPSGESSTAPGST SSTAESPGPGTSPSG ESSTAPGTSESATPE SGPGTSTEPSEGSAP GTSTEPSEGSAPGSS PSASTGTGPGSSTPS GATGSPGASPGTSS TGSPGTSTPESGSAS PGTSPSGESSTAPGT SPSGESSTAP | 638 |

TABLE 12-continued

DNA and amino acid sequences for AM144 segments

| Clone | DNA Sequence | SEQ ID NO: | Protein Sequence | SEQ ID NO: |
|---|---|---|---|---|
| LCW462_r70 | GGTACCTCTGAAAGCGCTACTCCGGAGTCTGGCCCAGGT<br>ACCTCTACTGAACCGTCTGAGGGTAGCGCTCCAGGTACTT<br>CTACTGAACCGTCCGAAGGTAGCGCACCAGGTAGCCCTG<br>CTGGCTCTCCGACTTCTACTGAGGAAGGTAGCCCGGCTGG<br>TTCTCCGACTTCTACTGAGGAAGGTACTTCTACCGAACCT<br>TCCGAAGGTAGCGCTCCAGGTTCTAGCCCTTCTGCTTCCA<br>CCGGTACTGGCCCAGGTAGCTCTACCCCTTCTGGTGCTAC<br>CGGCTCCCCAGGTAGCTCTACTCCTTCTGGTGCAACTGGC<br>TCTCCAGGTAGCGAACCGGCAACTTCCGGCTCTGAAACC<br>CCAGGTACTTCTGAAAGCGCTACTCCTGAGTCTGGCCCAG<br>GTAGCGAACCTGCTACCTCTGGCTCTGAAACCCCA | 639 | GTSESATPESGPGT<br>STEPSEGSAPGTSTE<br>PSEGSAPGSPAGSP<br>TSTEEGSPAGSPTST<br>EEGTSTEPSEGSAP<br>GSSPSASTGTGPGS<br>STPSGATGSPGSSTP<br>SGATGSPGSEPATS<br>GSETPGTSESATPES<br>GPGSEPATSGSETP | 640 |
| LCW462_r72 | GGTACTTCTACCGAACCGTCCGAAGGCAGCGCTCCAGGT<br>ACCTCTACTGAACCTTCCGAGGGCAGCGCTCCAGGTACCT<br>CTACCGAACCTTCTGAAGGTAGCGCACCAGGTAGCTCTA<br>CCCCGTCTGGTGCTACCGGTTCCCCAGGTGCTTCTCCTGG<br>TACTAGCTCTACCGGTTCTCCAGGTAGCTCTACCCCGTCT<br>GGTGCTACTGGCTCTCCAGGTACTTCTGAAAGCGCAACCC<br>CTGAATCCGGTCAGGTAGCGAACCGGCTACTTCTGGCTC<br>TGAGACTCCAGGTACTTCTACCGAACCGTCCGAAGGTAG<br>CGCACCAGGTTCTACTAGCGAATCTCCTTCTGGCACTGCA<br>CCAGGTTCTACCAGCGAATCTCCGTCTGGCACTGCACCAG<br>GTACCTCTACCCCTGAAAGCGGTTCCGCTTCTCCA | 641 | GTSTEPSEGSAPGT<br>STEPSEGSAPGTSTE<br>PSEGSAPGSSTPSG<br>ATGSPGASPGTSST<br>GSPGSSTPSGATGS<br>PGTSESATPESGPGS<br>EPATSGSETPGTSTE<br>PSEGSAPGSTSESPS<br>GTAPGSTSESPSGT<br>APGTSTPESGSASP | 642 |
| LCW462_r73 | GGTACCTCTACTCCTGAAAGCGGTTCTGCATCTCCAGGTT<br>CCACTAGCTCTACCGCAGAATCTCCGGGCCCAGGTTCTAC<br>TAGCTCTACTGCTGAATCTCCTGGCCCAGGTTCTAGCCCT<br>TCTGCATCTACTGGTACTGGCCCAGGTAGCTCTACTCCTT<br>CTGGTGCTACCGGCTCTCCAGGTGCTTCTCCGGGTACTAG<br>CTCTACCGGTTCTCCAGGTAGCGAACCGGCAACCTCCGGC<br>TCTGAAACCCCAGGTACCTCTGAAAGCGCTACTCCTGAAT<br>CCGGCCCAGGTAGCCCGGCAGGTTCTCCGACTTCCACTGA<br>GGAAGGTTCTACTAGCGAATCTCCTTCTGGCACTGCACCA<br>GGTTCTACCAGCGAATCTCCGTCTGGCACTGCACCAGGTA<br>CCTCTACCCCTGAAAGCGGTTCCGCTTCTCCC | 643 | GTSTPESGSASPGST<br>SSTAESPGPGSTSST<br>AESPGPGSSPSAST<br>GTGPGSSTPSGATG<br>SPGASPGTSSTGSP<br>GSEPATSGSETPGT<br>SESATPESGPGSPA<br>GSPTSTEEGSTSESP<br>SGTAPGSTSESPSGT<br>APGTSTPESGSASP | 644 |
| LCW462_r78 | GGTAGCCCGGCTGGCTCTCCTACCTCTACTGAGGAAGGTA<br>CTTCTGAAAGCGCTACTCCTGAGTCTGGTCCAGGTACCTC<br>TACTGAACCGTCCGAAGGTAGCGCTCCAGGTTCTACCAG<br>CGAATCTCCTTCTGGCACCGCTCCAGGTTCTACTAGCGAA<br>TCCCCGTCTGGTACCGCACCAGGTACTTCTCCTAGCGGCG<br>AATCTTCTACCGCACCAGGTACCTCTACCGAACCTTCCGA<br>AGGTAGCGCTCCAGGTAGCCCGGCAGGTTCTCCTACTTCC<br>ACTGAGGAAGGTACTTCTACCGAACCTTCTGAGGGTAGC<br>GCACCAGGTAGCGAACCTGCAACCTCTGGCTCTGAAACC<br>CCAGGTACCTCTGAAAGCGCTACTCCTGAATCTGGCCCAG<br>GTACTTCTACTGAACCGTCCGAGGGCAGCGCACCA | 645 | GSPAGSPTSTEEGT<br>SESATPESGPGTSTE<br>PSEGSAPGSTSESPS<br>GTAPGSTSESPSGT<br>APGTSPSGESSTAP<br>GTSTEPSEGSAPGSP<br>AGSPTSTEEGTSTEP<br>SEGSAPGSEPATSG<br>SETPGTSESATPESG<br>PGTSTEPSEGSAP | 646 |
| LCW462_r79 | GGTACCTCTACCGAACCTTCCGAAGGTAGCGCTCCAGGT<br>AGCCCGGCAGGTTCTCCTACTTCCACTGAGGAAGGTACTT<br>CTACCGAACCTTCTGAGGGTAGCGCACCAGGTACCTCCCC<br>TAGCGGCGAATCTTCTACTGCTCCAGGTACCTCTCCTAGC<br>GGCGAATCTTCTACCGCTCCAGGTACCTCCCCTAGCGGTG<br>AATCTTCTACCGCACCAGGTTCTACCAGCGAATCCCCTTC<br>TGGTACTGCTCCAGGTTCTACCAGCGAATCCCCTTCTGGC<br>ACCGCACCAGGTTCTACCCCTGAAAGCGGCTCTGCCGCTT<br>CTCCAGGTAGCGAACCTGCAACCTCTGGCTCTGAAACCCC<br>AGGTACCTCTGAAAGCGCTACTCCTGAATCTGGCCCAGGT<br>ACTTCTACTGAACCGTCCGAGGGCAGCGCACCA | 647 | GTSTEPSEGSAPGSP<br>AGSPTSTEEGTSTEP<br>SEGSAPGTSPSGESS<br>TAPGTSPSGESSTAP<br>GTSPSGESSTAPGST<br>SESPSGTAPGSTSES<br>PSGTAPGTSTPESGS<br>ASPGSEPATSGSETP<br>GTSESATPESGPGT<br>STEPSEGSAP | 648 |
| LCW462_r87 | GGTAGCGAACCGGCAACCTCTGGCTCTGAAACCCCAGGT<br>ACCTCTGAAAGCGCTACTCCGGAATCTGGTCCAGGTACTT<br>CTGAAAGCGCTACTCCGGAATCCGGTCCAGGTACTTCTCC<br>GAGCGGTGAATCTTCTACCGCACCAGGTTCTACTAGCTCT<br>ACCGCTGAATCTCCGGGCCCAGGTACTTCTCCGAGCGGTG<br>AATCTTCTACTGCTCCAGGTTCTACTAGCGAATCCCCGTC<br>TGGTACTGCTCCAGGTACTTCCCCTAGCGGTGAATCTTCT<br>ACTGCTCCAGGTTCTACCAGCTCTACCGCAGAATCTCCGG<br>GTCCAGGTAGCTCTACTCCGTCTGGTGCAACCGGTTCCCC<br>AGGTAGCTCTACCCCTTCTGGTGCAACCGGCTCCCCAGGT<br>AGCTCTACCCCTTCTGGTGCAAACTGGCTCTCC | 649 | GSEPATSGSETPGT<br>SESATPESGPGTSES<br>ATPESGPGTSPSGES<br>STAPGSTSSTAESPG<br>PGTSPSGESSTAPGS<br>TSESPSGTAPGTSPS<br>GESSTAPGSTSSTA<br>ESPGPGSSTPSGAT<br>GSPGSSTPSGATGS<br>PGSSTPSGANWLS | 650 |

TABLE 12-continued

DNA and amino acid sequences for AM144 segments

| Clone | DNA Sequence | SEQ ID NO: | Protein Sequence | SEQ ID NO: |
|---|---|---|---|---|
| LCW462_r88 | GGTAGCCCTGCTGGCTCTCCGACTTCTACTGAGGAAGGTA GCCCGGCTGGTTCTCCGACTTCTACTGAGGAAGGTACTTC TACCGAACCTTCCGAAGGTAGCGCTCCAGGTACCTCTACT GAACCTTCCGAAGGCAGCGCTCCAGGTACCTCTACCGAA CCGTCCGAGGGCAGCGCACCAGGTACTTCTGAAAGCGCA ACCCCTGAATCCGGTCCAGGTGCATCTCCTGGTACCAGCT CTACCGGTTCTCCAGGTAGCTCTACTCCTTCTGGTGCTAC TGGCTCTCCAGGTGCTTCCCCGGGTACCAGCTCTACCGGT TCTCCAGGTAGCTCTACCCCGTCTGGTGCTACTGGTTCTC CAGGTACTCCGGGCAGCGGTACTGCTTCTTCCTCTCCAGG TAGCTCTACCCCTTCTGGTGCTACTGGCTCTCCA | 651 | GSPAGSPTSTEEGSP AGSPTSTEEGTSTEP SEGSAPGTSTEPSE GSAPGTSTEPSEGS APGTSESATPESGP GASPGTSSTGSPGS STPSGATGSPGASP GTSSTGSPGSSTPSG ATGSPGTPGSGTAS SSPGSSTPSGATGSP | 652 |
| LCW462_r89 | GGTAGCTCTACCCCGTCTGGTGCTACTGGTTCTCCAGGTA CTCCGGGCAGCGGTACTGCTTCTTCCTCTCCAGGTAGCTC TACCCCTTCTGGTGCTACTGGCTCTCCAGGTAGCCCGGCT GGCTCTCCTACCTCTACTGAGGAAGGTACTTCTGAAAGCG CTACTCCTGAGTCTGGTCCAGGTACCTCTACTGAACCGTC CGAAGGTAGCGCTCCAGGTACCTCTGAAAGCGCAACTCC TGAGTCTGGCCCAGGTAGCGAACCTGCTACCTCCGGCTCT GAGACTCCAGGTACCTCTGAAAGCGCAACCCCGGAATCT GGTCCAGGTACTTCTACTGAACCGTCTGAAGGTAGCGCA CCAGGTACTTCTGAAAGCGCAACCCCGGAATCCGGCCCA GGTACCTCTGAAAGCGCAACCCCGGAGTCCGGCCCA | 653 | GSSTPSGATGSPGT PGSGTASSSPGSSTP SGATGSPGSPAGSP TSTEEGTSESATPES GPGTSTEPSEGSAP GTSESATPESGPGS EPATSGSETPGTSES ATPESGPGTSTEPSE GSAPGTSESATPES GPGTSESATPESGP | 654 |

Example 7

Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8

Construction of XTEN_AM432

We generated a library of XTEN_AM432 segments by recombining segments from library LCW0462 of XTEN_AM144 segments and segments from library LCW0463 of XTEN_AM288 segments. This new library of XTEN_AM432 segment was designated LCW0464. Plasmid was isolated from cultures of *E. coli* harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTEN_AM432 segments using preferred segments of XTEN_AM144 and XTEN_AM288. Screening of this library yielded 4 isolates that were selected for further construction

Example 9

Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIforP: AGGTGCAAGCGCAAGCGGCGCGC-CAAGCACGGGAGGTTCGTCTTCACTCGAGGGTAC (SEQ ID NO: 655) and the non-phosphorylated oligonucleotide BsaI-AscI-Kpnlrev: CCTCGAGTGAAGACGAAC-CTCCCGTGCTTGGCGCGCCGCTTGCGCTTGC (SEQ ID NO: 656) for introducing the sequencing island A (SI-A) which encodes amino acids GASASGAPSTG (SEQ ID NO: 657) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in Example 5. This new library of XTEN_AM875 segment was designated LCW0481.

Example 10

Construction of XTEN_AM1318

We annealed the phosphorylated oligonucleotide BsaI-FseI-KpnIforP: AGGTCCAGAACCAACGGGGCCGGC-CCCAAGCGGAGGTTCGTCTTCACTCGAGGGTAC (SEQ ID NO: 658) and the non-phosphorylated oligonucleotide BsaI-FseI-Kpnlrev: CCTCGAGTGAAGACGAAC-CTCCGCTTGGGGCCGGCCCCGTTGGTTCTGG (SEQ ID NO: 659) for introducing the sequencing island B (SI-B) which encodes amino acids GPEPTGPAPSG (SEQ ID NO: 660) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in Example 5. This new library of XTEN_AM443 segments was designated LCW0480.

We generated a library of XTEN_AM1318 segments by recombining segments from library LCW0480 of XTEN_AM443 segments and segments from library LCW0481 of XTEN_AM875 segments using the same dimerization process as in Example 5. This new library of XTEN_AM1318 segment was designated LCW0487.

Example 11

Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12

Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13

Construction of XTEN_AG864

Using the several consecutive rounds of dimerization, we assembled a collection of XTEN_AG864 sequences starting from segments of XTEN_AG36 listed in Example 4. These sequences were assembled as described in Example 5. Several isolates from XTEN_AG864 were evaluated and found to show good expression and excellent solubility under physiological conditions. A full-length clone of XTEN_AG864 had excellent solubility and showed half-life exceeding 60 h in cynomolgus monkeys.

Example 14

Construction of N-Terminal Extensions of XTEN-Construction and Screening of 12mer Addition Libraries This example details a step in the optimization of the N-terminus of the XTEN protein to promote the initiation of translation to allow for expression of XTEN fusions at the N-terminus of fusion proteins without the presence of a helper domain. Historically expression of proteins with XTEN at the N-terminus was poor, yielding values that would essentially undetectable in the GFP fluorescence assay (<25% of the expression with the N-terminal CBD helper domain). To create diversity at the codon level, seven amino acid sequences were selected and prepared with a diversity of codons. Seven pairs of oligonucleotides encoding 12 amino acids with codon diversities were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of seven libraries. The resulting clones have N-terminal XTEN 12mers fused in-frame to XTEN_AM875-GFP to allow use of GFP fluorescence for screening the expression. Individual colonies from the seven created libraries were picked and grown overnight to saturation in 500 µl of super broth media in a 96 deep well plate. The number of colonies picked ranged from approximately half to a third of the theoretical diversity of the library (see Table 13).

TABLE 13

Theoretical Diversity and Sampling Numbers for 12mer Addition Libraries. The amino acid residues with randomized codons are underlined.

| Library | Motif Family | Amino Acid Sequence | SEQ ID NO: | Theoretical Diversity | Number screened |
|---|---|---|---|---|---|
| LCW546 | AE12 | MASPAGSPTSTEE | 661 | 572 | 2 plates (168) |
| LCW547 | AE12 | MATSESATPESGP | 662 | 1536 | 5 plates (420) |
| LCW548 | AF12 | MATSPSGESSTAP | 663 | 192 | 2 plates (168) |
| LCW549 | AF12 | MESTSSTAESPGP | 664 | 384 | 2 plates (168) |
| LCW552 | AG12 | MASSTPSGATGSP | 665 | 384 | 2 plates (168) |
| LCW553 | AG12 | MEASPGTSSTGSP | 666 | 384 | 2 plates (168) |
| LCW554 | (CBD-like) | MASTPESGSSG | 667 | 32 | 1 plate (84) |

Figure 5:
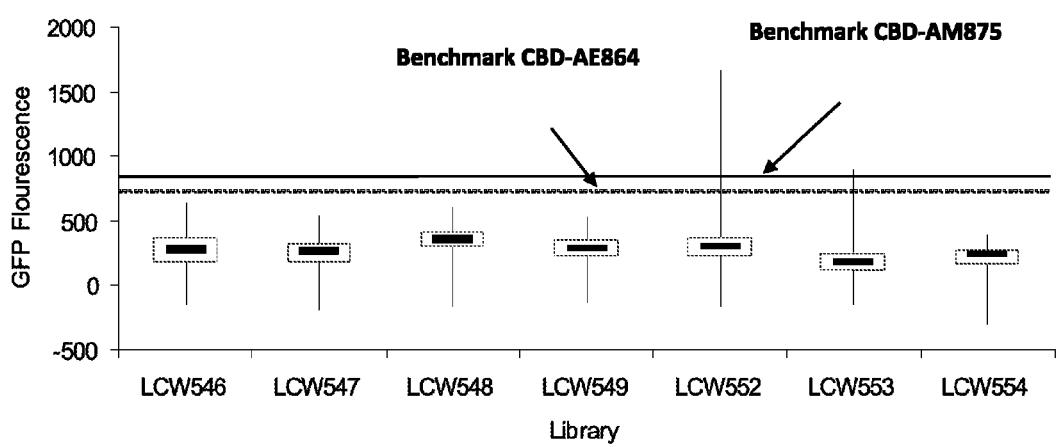
FIG. 5 shows results of expression assays for the indicated constructs comprising GFP and XTEN sequences. The expression cultures were assayed using a fluorescence plate reader (excitation 395 nm, emission 510 nm) to determine the amount of GFP reporter present. The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. The results also show that the libraries starting with amino acids MA had better expression levels than those beginning with ME (see Example 16).
Figure 7:
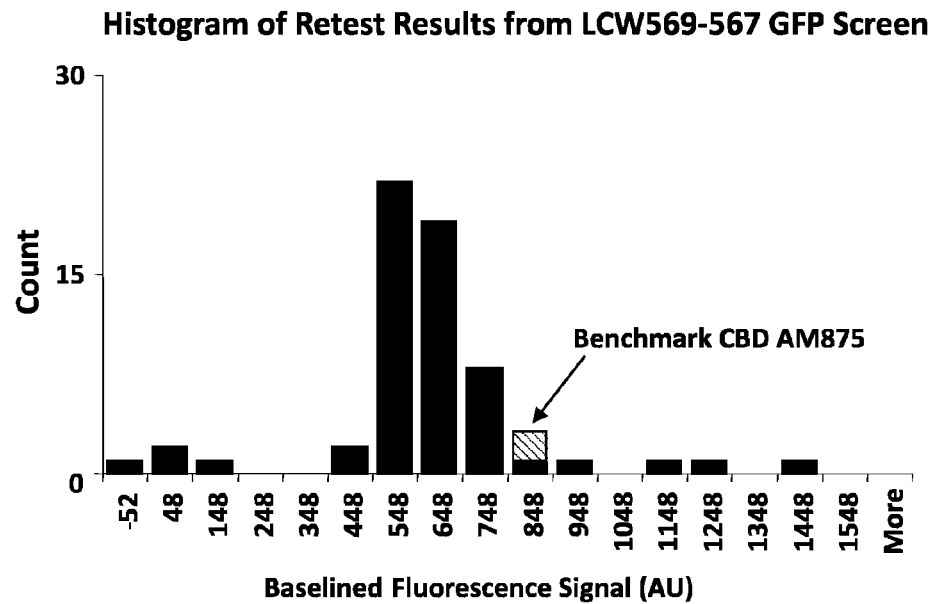
FIG. 7 shows a histogram of a retest of the top 75 clones after the optimization step, as described in Example 17, for GFP fluorescence signal, relative to the benchmark CBD_AM875 construct. The results indicated that several clones were now superior to the benchmark clones.

The saturated overnight cultures were used to inoculate fresh 500 ml cultures in auto-induction media in which they were grown overnight at 26° C. These expression cultures were then assayed using a fluorescence plate reader (excitation 395 nm, emission 510 nm) to determine the amount of GFP reporter present (see FIG. 5 for results of expression assays). The results indicated that while median expression levels were approximately half of the expression levels compared to the "benchmark" CBD N-terminal helper domain, the best clones from the libraries were much closer to the benchmarks, indicating that further optimization around those sequences was warranted. This is in contrast to previous XTEN versions that were <25% of the expression levels of the CBD N-terminal benchmark. The results also show that the libraries starting with amino acids MA had better expression levels than those beginning with ME. This was most apparent when looking at the best clones, which were closer to the benchmarks as they mostly start with MA. Of the 176 clones within 33% of the CBD-AM875 benchmark, 87% begin with MA, where as only 75% of the sequences in the libraries beginning with MA, a clear over representation of the clones beginning with MA at the highest level of expression. 96 of the best clones were sequenced to confirm identity and twelve sequences (see Table 14), 4 from LCW546, 4 from LCW547 and 4 from LCW552 were selected for further optimization.

and fourth residues were designed, annealed and ligated into the NdeI/BsaI restriction enzyme digested stuffer vector pCW0551 (Stuffer-XTEN_AM875-GFP), and transformed into *E. coli* BL21Gold(DE3) competent cells to obtain colonies of three libraries LCW0569-571. With 24×TEN codons the theoretical diversity of each library is 576 unique clones. A total of 504 individual colonies from the three created libraries were picked and grown overnight to saturation in 500 ml of super broth media in a 96 deep well plate. This provided sufficient coverage to understand relative library performance and sequence preferences. The saturated overnight cultures were used to inoculate new 500 ml cultures in auto-induction media in which were grown overnight at 26° C. These expression cultures were then assayed using a fluorescence plate reader (excitation 395 nm, emission 510 nm) to determine the amount of GFP reporter present. The top 75 clones from the screen were sequenced and retested for GFP reporter expression versus the benchmark samples (see FIG. 7). Fifty-two clones yielded usable sequencing data and were used for subsequent analysis. The results were broken down by library and indicate that LCW569 was the superior library.

TABLE 14

Advanced 12mer DNA Nucleotide Sequences

| Clone | DNA Nucleotide Sequence | SEQ ID NO: |
|---|---|---|
| LCW546_02 | ATGGCTAGTCCGGCTGGCTCTCCGACCTCCACTGAGGAAGGTACTTCTACT | 668 |
| LCW546_06 | ATGGCTAGTCCTGCTGGCTCTCCAACCTCCACTGAGGAAGGTACTTCTACT | 669 |
| LCW546_07 | ATGGCTAGTCCAGCAGGCTCTCCTACCTCCACCGAGGAAGGTACTTCTACT | 670 |
| LCW546_09 | ATGGCTAGTCCTGCTGGCTCTCCGACCTCTACTGAGGAAGGTACTTCTACT | 671 |
| LCW547_03 | ATGGCTACATCCGAAAGCGCAACCCCTGAGTCCGGTCCAGGTACTTCTACT | 672 |
| LCW547_06 | ATGGCTACATCCGAAAGCGCAACCCCTGAATCTGGTCCAGGTACTTCTACT | 673 |
| LCW547_10 | ATGGCTACGTCTGAAAGCGCTACTCCGGAATCTGGTCCAGGTACTTCTACT | 674 |
| LCW547_17 | ATGGCTACGTCCGAAAGCGCTACCCCTGAATCCGGTCCAGGTACTTCTACT | 675 |
| LCW552_03 | ATGGCTAGTTCTACCCCGTCTGGTGCAACCGGTTCCCCAGGTACTTCTACT | 676 |
| LCW552_05 | ATGGCTAGCTCCACTCCGTCTGGTGCTACCGGTTCCCCAGGTACTTCTACT | 677 |
| LCW552_10 | ATGGCTAGCTCTACTCCGTCTGGTGCTACTGGTTCCCCAGGTACTTCTACT | 678 |
| LCW552_11 | ATGGCTAGTTCTACCCCTTCTGGTGCTACTGGTTCTCCAGGTACTTCTACT | 679 |

Example 15

Construction of N-Terminal Extensions of XTEN-Construction and Screening of Libraries Optimizing Codons 3 and 4

This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the third and fourth codons were randomized to determine preferences. Three libraries, based upon best clones from LCW546, LCW547 and LCW552, were designed with the third and fourth residues modified such that all combinations of allowable XTEN codons were present at these positions (see FIG. 6). In order to include all the allowable XTEN codons for each library, nine pairs of oligonucleotides encoding 12 amino acids with codon diversities of third The results are presented in Table 15. Surprisingly, it was discovered that base-lined fluorescence readings for the best clones were −900 AU, whereas the CBD N-terminal benchmark was only −600 AU. This indicates that this library had instituted an approximately 33% improvement over the best clones from the previous library which were approximately equal in expression to the CBD N-terminal benchmark.

TABLE 15

Third and Fourth Codon Optimization Library Comparison

|  | LCW569 | LCW570 | LCW571 |
|---|---|---|---|
| N | 21 | 15 | 16 |
| Mean Fluorescence (AU) | 628 | 491 | 537 |
| SD | 173 | 71 | 232 |
| CV | 28% | 15% | 43% |

Further trends were seen in the data showing preferences for particular codons at the third and fourth position. Within the LCW569 library the glutamate codon GAA at the third position and the threonine codon ACT were associated with higher expression as seen in Table 16.

TABLE 16

Preferred Third and Fourth Codons in LCW569

|  | 3 = GAA | Rest | 4 = ACT | Rest |
|---|---|---|---|---|
| N | 8 | 13 | 4 | 17 |
| Mean Fluorescence (AU) | 749 | 554 | 744 | 601 |
| SD | 234 | 47 | 197 | 162 |
| CV | 31% | 9% | 26% | 27% |

Additionally, the retest of the top 75 clones indicated that several were now superior to the benchmark clones.

Example 16

Construction of N-Terminal Extensions of XTEN-Construction and Screening of Combinatorial 12mer and 36mer Libraries This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the N-terminus was examined in a broader context by combining the 12 selected 12mer sequences (see Example supra) at the very N-terminus followed by 125 previously constructed 36mer segments (see example supra) in a combinatorial manner. This created novel 48mers at the N-terminus of the XTEN protein and enabled the assessment of the impact of longer-range interactions at the N-terminus on expression of the longer sequences (FIG. 8). Similar to the dimerization procedures used to assemble 36mers (see Example infra), the plasmids containing the 125 selected 36mer segments were digested with restriction enzymes BbsI/NcoI and the appropriate fragment was gel-purified. The plasmid from clone AC94 (CBD-XTEN_AM875-GFP) was also digested with BsaI/NcoI and the appropriate fragments were gel-purified. These fragments were ligated together and transformed into E. coli BL21Gold(DE3) competent cells to obtain colonies of the library LCW0579, which also served as the vector for further cloning 12 selected 12mers at the very N-terminus. The plasmids of LCW0579 were digested with NdeI/EcoRI/BsaI and the appropriate fragments were gel-purified. 12 pairs of oligonucleotides encoding 12 selected 12mer sequences were designed, annealed and ligated with the NdeI/EcoRI/BsaI digested LCW0579 vector, and transformed into E. coli BL21Gold (DE3) competent cells to obtain colonies of the library LCW0580. With a theoretical diversity of 1500 unique clones, a total of 1512 individual colonies from the created library were picked and grown overnight to saturation in 500 ml of super broth media in a 96 deep well plate. This provided sufficient coverage to understand relative library performance and sequence preferences. The saturated overnight cultures were used to inoculate new 500 ml cultures in auto-induction media that were grown overnight at 26° C. These expression cultures were then assayed using a fluorescence plate reader (excitation 395 nm, emission 510 nm) to determine the amount of GFP reporter present. The top 90 clones were sequenced and retested for GFP reporter expression. 83 clones yielded usable sequencing data and were used for subsequent analysis. The sequencing data was used to determine the lead 12mer that was present in each clone and the impact of each 12mer on expression was assessed. Clones LCW546_06 and LCW546_09 stood out as being the superior N-terminus (see Table 17).

TABLE 17

Relative Performance of Clones Starting with LCW546 06 and LCW459 09

|  | LCW546_06 | All Others | LCW546_09 | All Others |
|---|---|---|---|---|
| N | 11 | 72 | 9 | 74 |
| Mean Fluorescence (AU) | 1100 | 752 | 988 | 775 |
| SD | 275 | 154 | 179 | 202 |
| CV | 25% | 20% | 18% | 26% |

The sequencing and retest also revealed several instances of independent replicates of the same sequence in the data producing similar results, thus increasing confidence in the assay. Additionally, 10 clones with 6 unique sequences were superior to the benchmark clone. They are presented in Table 18. It was noted that these were the only occurrences of these sequences and in no case did one of these sequences occur and fail to beat the bench-mark clone. These six sequences were advanced for further optimization.

TABLE 18

Combinatorial 12mer and 36mer Clones Superior to Benchmark Clone

| Clone Name | First 60 codons | SEQ ID NO: | 12mer Name | 36mer Name |
|---|---|---|---|---|
| LCW580_51 | ATGGCTAGTCCTGCTGGCTCTCCAACCTCCACTGAGG AAGGTGCATCCCCGGGCACCAGCTCTACCGGTTCTC CAGGTAGCTCTACCCCGTCTGGTGCTACCGGCTCTCC AGGTAGCTCTACCCCGTCTGGTGCTACTGGCTCTCCA GGTACTTCTACTGAACCGTCTGAAGGCAGCGCA | 680 | LCW546_06 | LCW0404_040 |
| LCW580_81 | ATGGCTAGTCCTGCTGGCTCTCCAACCTCCACTGAGG AAGGTGCATCCCCGGGCACCAGCTCTACCGGTTCTC CAGGTAGCTCTACCCCGTCTGGTGCTACCGGCTCTCC AGGTAGCTCTACCCCGTCTGGTGCTACTGGCTCTCCA GGTACTTCTACTGAACCGTCTGAAGGCAGCGCA | 681 | LCW546_06 | LCW0404_040 |

TABLE 18-continued

Combinatorial 12mer and 36mer Clones Superior to Benchmark Clone

| Clone Name | First 60 codons | SEQ ID NO: | 12mer Name | 36mer Name |
|---|---|---|---|---|
| LCW580_38 | ATGGCTAGTCCTGCTGGCTCTCCAACCTCCACTGAGG AAGGTACTTCTACCGAACCGTCCGAGGGTAGCGCAC CAGGTAGCCCAGCAGGTTCTCCTACCTCCACCGAGG AAGGTACTTCTACCGAACCGTCCGAGGGTAGCGCAC CAGGTACTTCTACTGAACCGTCTGAAGGCAGCGCA | 682 | LCW546_06 | LCW0402_041 |
| LCW580_63 | ATGGCTAGTCCTGCTGGCTCTCCGACCTCTACTGAGG AAGGTACTTCTACTGAACCGTCTGAAGGCAGCGCAC CAGGTAGCGAACCGGCTACTTCCGGTTCTGAAACCC CAGGTAGCCCAGCAGGTTCTCCAACTTCTACTGAAG AAGGTACTTCTACTGAACCGTCTGAAGGCAGCGCA | 683 | LCW546_09 | LCW0402_020 |
| LCW580_06 | ATGGCTAGTCCTGCTGGCTCTCCAACCTCCACTGAGG AAGGTACCCCGGGTAGCGGTACTGCTTCTTCCTCTCC AGGTAGCTCTACCCCTTCTGGTGCAACCGGCTCTCCA GGTGCTTCTCCGGGCACCAGCTCTACCGGTTCTCCAG GTACTTCTACTGAACCGTCTGAAGGCAGCGCA | 684 | LCW546_06 | LCW0404_031 |
| LCW580_35 | ATGGCTAGTCCTGCTGGCTCTCCGACCTCTACTGAGG AAGGTACTTCTACTGAACCGTCTGAAGGCAGCGCAC CAGGTAGCGAACCGGCTACTTCCGGTTCTGAAACCC CAGGTAGCCCAGCAGGTTCTCCAACTTCTACTGAAG AAGGTACTTCTACTGAACCGTCTGAAGGCAGCGCA | 685 | LCW546_09 | LCW0402_020 |
| LCW580_67 | ATGGCTAGTCCTGCTGGCTCTCCGACCTCTACTGAGG AAGGTACCTCCCCTAGCGGCGAATCTTCTACTGCTCC AGGTACCTCTCCTAGCGGCGAATCTTCTACCGCTCCA GGTACCTCCCCTAGCGGTGAATCTTCTACCGCACCA GGTACTTCTACTGAACCGTCTGAAGGCAGCGCA | 686 | LCW546_09 | LCW0403_064 |
| LCW580_13 | ATGGCTAGTCCTGCTGGCTCTCCGACCTCTACTGAGG AAGGTACCTCTACTCCGGAAAGCGGTTCCGCATCTC CAGGTTCTACCAGCGAATCCCCGTCTGGCACCGCAC CAGGTTCTACTAGCTCTACTGCTGAATCTCCGGGCCC AGGTACTTCTACTGAACCGTCTGAAGGCAGCGCA | 687 | LCW546_09 | LCW0403_060 |
| LCW580_88 | ATGGCTAGTCCTGCTGGCTCTCCGACCTCTACTGAGG AAGGTACCTCCCCTAGCGGCGAATCTTCTACTGCTCC AGGTACCTCTCCTAGCGGCGAATCTTCTACCGCTCCA GGTACCTCCCCTAGCGGTGAATCTTCTACCGCACCA GGTACTTCTACTGAACCGTCTGAAGGCAGCGCA | 688 | LCW546_09 | LCW0403_064 |
| LCW580_11 | ATGGCTAGTCCTGCTGGCTCTCCGACCTCTACTGAGG AAGGTACCTCTACTCCGGAAAGCGGTTCCGCATCTC CAGGTTCTACCAGCGAATCCCCGTCTGGCACCGCAC CAGGTTCTACTAGCTCTACTGCTGAATCTCCGGGCCC AGGTACTTCTACTGAACCGTCTGAAGGCAGCGCA | 689 | LCW546_09 | LCW0403_060 |

Example 17

Construction of N-Terminal Extensions of XTEN-Construction and Screening of Combinatorial 12mer and 36mer Libraries for XTEN-AN1875 and XTEN-AE864

This example details a step in the optimization of the N-terminus of the XTEN protein to promote the initiation of translation to allow for expression of XTEN fusions at the N-terminus of proteins without the presence of a helper domain. With preferences for the first four codons (see Examples supra, and for the best pairing of N-terminal 12mers and 36mers (see Example supra) established, a combinatorial approach was undertaken to examine the union of these preferences. This created novel 48mers at the N-terminus of the XTEN protein and enabled the testing of the confluence of previous conclusions. Additionally, the ability of these leader sequences to be a universal solution for all XTEN proteins was assessed by placing the new 48mers in front of both XTEN-AE864 and XTEN-AM875. Instead of using all 125 clones of 36mer segment, the plasmids from 6 selected clones of 36mer segment with best GFP expression in the combinatorial library were digested with NdeI/EcoRI/BsaI and the appropriate fragments were gel-purified. The plasmids from clones AC94 (CBD-XTEN_AM875-GFP) and AC104 (CBD-XTEN_AE864-GFP) were digested with digested with NdeI/EcoRI/BsaI and the appropriate fragments were gel-purified. These fragments were ligated together and transformed into E. coli BL21Gold(DE3) competent cells to obtain colonies of the libraries LCW0585 (—XTEN_AM875-GFP) and LCW0586 (—XTEN_AE864-GFP), which could also serve as the vectors for further cloning 8 selected 12mers at the very N-terminus. The plasmids of LCW0585 and LCW0586 were digested with NdeI/EcoRI/BsaI and the appropriate fragments were gel-purified. 8 pairs of oligonucleotides encoding 8 selected 12mer sequences with best GFP expression in the previous (Generation 2) screening were designed, annealed and ligated with the NdeI/EcoRI/BsaI digested LCW0585 and LCW0586 vectors, and transformed into E. coli BL21Gold(DE3) competent cells to obtain colonies of the final libraries LCW0587 (XTEN_AM923-GFP) and LCW0588 (XTEN_AE912-GFP). With a theoretical diversity of 48 unique clones, a total of 252 individual colonies from the created libraries were picked and grown overnight to saturation in 500 ml of super broth media in a 96 deep well plate. This provided sufficient coverage to understand relative library performance and sequence preferences. The saturated overnight cultures were used to inoculate new 500 ml cultures in auto-induction media in which were grown overnight at 26° C. These expression cultures were then assayed using a fluorescence plate reader (excitation 395 nm, emission 510 nm) to determine the amount of GFP reporter present. The top 36 clones were sequenced and retested for GFP reporter expression. 36 clones yielded usable sequencing data and these 36 were used for the subsequent analysis. The sequencing data determined the 12mer, the third codon, the fourth codon and the 36mer present in the clone and revealed that many of the clones were independent replicates of the same sequence. Additionally, the retest results for these clones are close in value, indicating the screening process was robust. Preferences for certain combinations at the N-terminus were seen and were consistently yielding higher fluorescence values approximately 50% greater than the benchmark controls (see Tables 19 and 20). These date support the conclusion that the inclusion of the sequences encoding the optimized N-terminal XTEN into the fusion protein genes conferred a marked enhancement on the expression of the fusion proteins.

TABLE 19

Preferred N-terminal Combinations for XTEN-AM875

| Clone Name | Number of Replicates | 12 mer | 36 mer | Mean | SD | CV |
|---|---|---|---|---|---|---|
| CBD-AM875 | NA | NA | NA | 1715 | 418 | 16% |
| LCW587_08 | 7 | LCW546_06_3 = GAA | LCW404_40 | 2333 | 572 | 18% |
| LCW587_17 | 5 | LCW546_09_3 = GAA | LCW403_64 | 2172 | 293 | 10% |

TABLE 20

Preferred N-terminal Combinations for XTEN-AE864

| Clone Name | Number of Replicates | 12 mer | 36 mer | Mean | SD | CV |
|---|---|---|---|---|---|---|
| AC82 | NA | NA | NA | 1979 | 679 | 24% |
| LCW588_14 | 8 | LCW546_06_opt3 | LCW404_31 | 2801 | 240 | 6% |
| LCW588_27 | 2 | LCW546_06_opt34 | LCW404_40 | 2839 | 556 | 15% |

Figure 9:
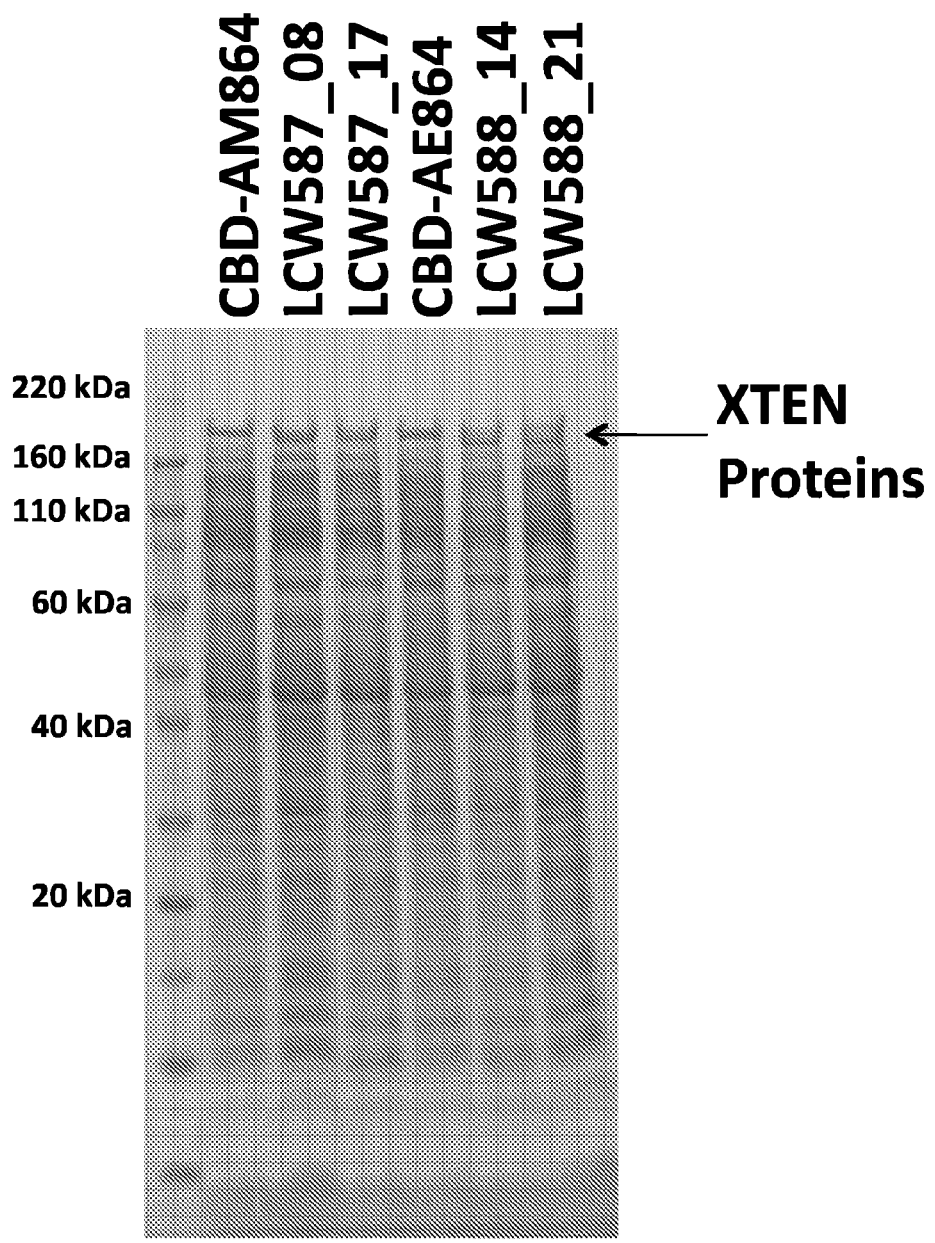
FIG. 9 shows an SDS-PAGE gel confirming expression of preferred clones obtained from the XTEN N-terminal codon optimization experiments, in comparison to benchmark XTEN clones comprising CBD leader sequences at the N-terminus of the construct sequences, as described in Example 17.

Notably, the preferred combination of the N-terminal for the XTEN-AM875 and the preferred combination for the XTEN-AE864 are not the same, indicating more complex interactions further than 150 bases from the initiation site influence expression levels. The sequences for the preferred nucleotide sequences are listed in Table 21 and the preferred clones were analyzed by SDS-PAGE to independently confirm expression (see FIG. 9). The complete sequences of XTEN_AM923 and XTEN_AE912 were selected for further analysis.

TABLE 21

Preferred DNA Nucleotide Sequences for first 48 Amino Acid Residues of N-terminal XTEN-AM875 and XTEN-AE864

| Clone Name | XTEN Modified | DNA Nucleotide Sequence | SEQ ID NO: |
|---|---|---|---|
| LCW587_08 | AM875 | ATGGCTGAACCTGCTGGCTCTCCAACCTCCACTGAGGAAGGTGCATCCC CGGGCACCAGCTCTACCGGTTCTCCAGGTAGCTCTACCCCGTCTGGTGC TACCGGCTCTCCAGGTAGCTCTACCCCGTCTGGTGCTACTGGCTCTCCA GGTACTTCTACTGAACCGTCTGAAGGCAGCGCA | 690 |
| LCW587_17 | AM875 | ATGGCTGAACCTGCTGGCTCTCCGACCTCTACTGAGGAAGGTACCTCCC CTAGCGGCGAATCTTCTACTGCTCCAGGTACCTCTCCTAGCGGCGAATC TTCTACCGCTCCAGGTACCTCCCCTAGCGGTGAATCTTCTACCGCACCA GGTACTTCTACTGAACCGTCTGAAGGCAGCGCA | 691 |
| LCW588_14 | AE864 | ATGGCTGAACCTGCTGGCTCTCCAACCTCCACTGAGGAAGGTACCCCGG GTAGCGGTACTGCTTCTTCCTCTCCAGGTAGCTCTACCCCTTCTGGTGCA ACCGGCTCTCCAGGTGCTTCTCCGGGCACCAGCTCTACCGGTTCTCCAG GTAGCCCGGCTGGCTCTCCTACCTCTACTGAG | 692 |

TABLE 21-continued

Preferred DNA Nucleotide Sequences for first 48 Amino Acid
Residues of N-terminal XTEN-AM875 and XTEN-AE864

| Clone Name | XTEN Modified | DNA Nucleotide Sequence | SEQ ID NO: |
|---|---|---|---|
| LCW588_27 | AE864 | ATGGCTGAAACTGCTGGCTCTCCAACCTCCACTGAGGAAGGTGCATCC CGGGCACCAGCTCTACCGGTTCTCCAGGTAGCTCTACCCCGTCTGGTGC TACCGGCTCTCCAGGTAGCTCTACCCCGTCTGGTGCTACTGGCTCTCCA GGTAGCCCGGCTGGCTCTCCTACCTCTACTGAG | 693 |

Example 18

Methods of Producing and Evaluating AaT-XTEN Containing aaT and AE_XTEN

A general schema for producing and evaluating aaT-XTEN compositions is presented in FIG. 11, and forms the basis for the general description of this Example. Using the disclosed methods and those known to one of ordinary skill in the art, together with guidance provided in the illustrative examples, a skilled artesian can create and evaluate aaT-XTEN fusion proteins comprising, XTENs, aaT and variants of aaT known in the art. The Example is, therefore, to be construed as merely illustrative, and not limitative of the methods in any way whatsoever; numerous variations will be apparent to the ordinarily skilled artisan. In this Example, an aaT-XTEN of an aaT linked to an XTEN of the AE family of motifs is created. The general scheme for producing polynucleotides encoding XTEN is presented in FIGS. 10 and 11. FIG. 10 is a schematic flowchart of representative steps in the assembly of a XTEN polynucleotide construct in one of the embodiments of the invention. Individual oligonucleotides 501 are annealed into sequence motifs 502 such as a 12 amino acid motif ("12-mer"), which is ligated to additional sequence motifs from a library that can multimerize to create a pool that encompasses the desired length of the XTEN 504, as well as ligated to a smaller concentration of an oligo containing BbsI, and KpnI restriction sites 503. The motif libraries can be limited to specific sequence XTEN families; e.g., AD, AE, AF, AG, AM, or AQ sequences of Table 3. As illustrated in FIG. 10, the XTEN length in this case is 36 amino acid residues, but longer lengths can be achieved by this process. For example, multimerization can be performed by ligation, overlap extension, PCR assembly or similar cloning techniques known in the art. The resulting pool of ligation products is gel-purified and the band with the desired length of XTEN is cut, resulting in an isolated XTEN gene with a stopper sequence 505. The XTEN gene can be cloned into a stuffer vector. In this case, the vector encodes an optional CBD sequence 506 and a GFP gene 508. Digestion is than performed with BbsI/HindIII to remove 507 and 508 and place the stop codon. The resulting product is then cloned into a BsaI/HindIII digested vector containing a gene encoding the aaT, resulting in the gene 500 encoding an aaT-XTEN fusion protein. As would be apparent to one of ordinary skill in the art, the methods can be applied to create constructs in alternative configurations and with varying XTEN lengths.

DNA sequences encoding aaT can be conveniently obtained by standard procedures known in the art from a cDNA library prepared from an appropriate cellular source, from a genomic library, or may be created synthetically (e.g., automated nucleic acid synthesis) using DNA sequences obtained from publicly available databases, patents, or literature references. In the present example, the native aaT sequence is utilized. A gene or polynucleotide encoding the aaT portion of the protein or its complement can be then be cloned into a construct, such as those described herein, which can be a plasmid or other vector under control of appropriate transcription and translation sequences for high level protein expression in a biological system. A second gene or polynucleotide coding for the XTEN portion or its complement can be genetically fused to the nucleotides encoding the terminus of the aaT gene by cloning it into the construct adjacent and in frame with the gene coding for the aaT, through a ligation or multimerization step. In this manner, a chimeric DNA molecule coding for (or complementary to) the aaT-XTEN fusion protein is generated within the construct. Optionally, a gene encoding for a second XTEN is inserted and ligated in-frame internally to the nucleotides encoding the aaT-encoding region. Optionally, this chimeric DNA molecule is transferred or cloned into another construct that is a more appropriate expression vector; e.g., a vector appropriate for a prokaryotic host cell such as *E. coli*, a eukaryotic host cell such as yeast, or a mammalian host cell such as CHO, BHK and the like. At this point, a host cell capable of expressing the chimeric DNA molecule is transformed with the chimeric DNA molecule. The vectors containing the DNA segments of interest can be transferred into an appropriate host cell by well-known methods, depending on the type of cellular host, as described supra.

Host cells containing the XTEN-aaT expression vector are cultured in conventional nutrient media modified as appropriate for activating the promoter. The culture conditions, such as temperature, pH and the like, are those previously used with the host cell selected for expression, and will be apparent to the ordinarily skilled artisan. After expression of the fusion protein, culture broth is harvested and separated from the cell mass and the resulting crude extract retained for purification of the fusion protein.

Gene expression is measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, gene expression is measured by immunological of fluorescent methods, such as immunohistochemical staining of cells to quantitate directly the expression of gene product. Antibodies useful for immunohistochemical staining and/or assay of sample fluids may be either monoclonal or polyclonal, and may be prepared in any mammal. Conveniently, the antibodies may be prepared against the aaT sequence polypeptide using a synthetic peptide based on the sequences provided herein or against exogenous sequence fused to aaT and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

The aaT-XTEN polypeptide product is purified via methods known in the art. Procedures such as gel filtration, affinity purification, salt fractionation, ion exchange chromatography, size exclusion chromatography, hydroxyapatite adsorption chromatography, hydrophobic interaction chromatography or gel electrophoresis are all techniques that may be used in the purification. Specific methods of purification are described in Robert K. Scopes, Protein Purification: Principles and Practice, Charles R. Castor, ed., Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

As illustrated in FIG. 11, the isolated aaT-XTEN fusion proteins would then be characterized for their chemical and activity properties. Isolated fusion protein is characterized, e.g., for sequence, purity, apparent molecular weight, solubility and stability using standard methods known in the art. The fusion protein meeting expected standards would then be evaluated for activity, which can be measured in vitro or in vivo by measuring one of the alpha 1-antitrypsin-associated parameters described herein, using one or more assays disclosed herein, or using the assays of the Examples or the assays of Table 39.

In addition, the aaT-XTEN fusion protein is administered to one or more animal species to determine standard pharmacokinetic parameters and pharmacodynamic properties, as described in Examples 30-33.

By the iterative process of producing, expressing, and recovering aaT-XTEN constructs, followed by their characterization using methods disclosed herein or others known in the art, the aaT-XTEN compositions comprising aaT and an XTEN can be produced and evaluated by one of ordinary skill in the art to confirm the expected properties such as enhanced solubility, enhanced stability, improved pharmacokinetics and reduced immunogenicity, leading to an overall enhanced therapeutic activity compared to the corresponding unfused aaT. For those fusion proteins not possessing the desired properties, a different sequence can be constructed, expressed, isolated and evaluated by these methods in order to obtain a composition with such properties.

Example 19

Construction of aaT-XTEN Genes and Vectors

Oligonucleotides were designed and constructed such that the entire aaT gene could be assembled through the tiling together of these oligonucleotides via designed complementary over hang regions under conditions of a 48° C. annealing temperature. The complementary regions were held constant, but the other regions of the oligonucleotides were varied such that a codon library was created with ~50% of the codons in the gene varied instead of the single native gene sequence. A PCR was performed to create a combined gene library which, as is typical, contained a variety of combinations of the oligonucleotides and presented as a smear on an agarose gel. A polishing PCR was performed to amplify those assemblies that had the correct termini using a set of amplification primers complimentary to the 5' and 3' ends of the gene. The product of this PCR was then gel purified, taking only bands at the ~1200 bp length of the expected aaT final gene product. This gel-purified product was digested with BsaI and NdeI and ligated into a similarly digested LCW464_187 construct, to produce an aaT-XTEN_AM464 gene, and trans-formed in BL21 gold competent cells. Colonies from this transformation were picked into 500 µl cultures of SB in 96 deep well plates and grown to saturation overnight. These cultures were stored at 4° C. after 20 µl of these cultures was used to inoculate 500 µl of auto-induction media and these cultures were grown at 26° C. for >24 hours. Following the growth the GFP fluorescence of 100 µl of these auto-induction media cultures was measured using a fluorescence plate reader. The GFP fluorescence is proportional to the number of molecules of aaT-XTEN_AM464 made and is therefore a read-out of total expression. The highest expressing clones were identified, and a new 1 ml overnight was started in SB from the original saturated overnight culture of that clone. Mini-preps were performed with these new cultures and the derived plasmids were sequenced to determine the exact nucleotide composition.

Example 20

Construction of aaT-XTEN_AM875 Genes and Vectors

Plasmids carrying aaT-XTEN genes were isolated by DNA miniprep and the constructs were confirmed by DNA sequencing. One clone was selected and a single point mutation in the aaT gene was corrected by standard site directed mutagenesis techniques. The aaT gene was then amplified by polymerase chain reaction (PCR) using the primers GAAG-GAGATATACATATGGCTGAAGA (SEQ ID NO: 694) and TGTTAATCCAACCCAGAAAGGAGGTC-GAGACCGATTGTTCT (SEQ ID NO: 695) to introduce NdeI and BsaI restriction endonuclease recognition sites that are compatible with the endonuclease sites flanking the stuffer sequence in the destination vectors. The destination vector was pCBD-XTEN_AM875, a derivative of pET30 (Novagen). The pCBD-XTEN_AM875 features a T7 promoter upstream of a cellulose binding domain (CBD) gene followed by an XTEN sequence fused in-frame. Restriction digested aaT DNA fragments were ligated into the cleaved pCBD-XTEN_AM875 vector using T4 DNA ligase with the aaT gene replacing the excised CBD gene. The aaT-XTEN_AM875 was then electroporated into BL21(DE3) Gold competent cells (Stratagene, La Jolla, Calif.). Transformants were screened by DNA miniprep and the desired constructs were confirmed by DNA sequencing. The final vectors yield the aaT-XTEN_AM875 gene under the control of a T7 promoter. The resulting DNA sequences and protein sequences are provided in Table 22.

Example 21

Construction of aaT-XTEN_AE288 and aaT-XTEN_AE576

Due to the high dosing of aaT that is required for clinical efficacy, it may be desirable in some applications to use constructs containing shorter XTEN segments. Short XTEN segments reduce the total mass of the resultant protein, thus reducing the total dose required for efficacy in the patient. This is expected to reduce the cost of goods and may improve efficacy and convenience of administration as well. To construct the short XTEN versions, plasmids carrying aaT-XTEN genes were isolated by DNA miniprep and the constructs were confirmed by DNA sequencing. The aaT gene was then amplified by polymerase chain reaction (PCR) using the primers GAAGGAGATATACATATGGCTGAAGA (SEQ ID NO: 696) and TGTTAATCCAACCCAGAAAG- GAGGTCGAGACCGATTGTTCT (SEQ ID NO: 697) to introduce NdeI and BsaI restriction endonuclease recognition sites that are compatible with the endonuclease sites flanking the stuffer sequence in the destination vectors. The destination vector was pCBD-XTEN_AE288 or pCBD-XTEN_AE576, derivatives of pET30 (Novagen). The plasmids feature a T7 promoter upstream of a cellulose binding domain (CBD) gene followed by an XTEN sequence of the designated length fused in-frame. Restriction digested aaT DNA fragments were ligated into the cleaved vector using T4 DNA ligase with the aaT gene replacing the excised CBD gene. The resultant plasmid was then electroporated into BL21(DE3) Gold competent cells (Stratagene, La Jolla, Calif.). Transformants were screened by DNA miniprep and the desired constructs were confirmed by DNA sequencing. The final vectors yield the aaT-XTEN_AE288 or aaT-XTEN_AE576 gene under the control of a T7 promoter. The resulting DNA sequences and protein sequences are provided in Table 22.

TABLE 22 aaT-XTEN DNA and amino acid sequences of Examples 22-23

| Clone Name | DNA Sequence | SEQ ID NO: | Amino Acid Sequence | SEQ ID NO: |
|---|---|---|---|---|
| aaT-AM875 (AC345) | ATGGCTGAAGATCCTCAGGGCGATGCTGCTCAAAAAACC GACACCTCTCACCATGATCAGGACCATCCGACTTTTAACA AAATCACCCCGAACCTGGCGGAATTCGCATTCTCCCTCTA TCGTCAGCTGGCTCACCAGTCTAACTCCACTAACATTTTC TTCTCCCCGGTTTCTATCGCTACCGCATTCGCTATGCTCTC TCTTGGCACTAAAGCTGACACCCACGACGAGATTCTTGA GGGTCTTAACTTCAATCTGACCGAAATCCCGGAGGCTCA GATCCACGAGGGCTTTCAGGAACTGCTGCGTACCCTGAA TCAACCTGATTCTCAACTGCAACTTACTACCGGTAACGGT CTGTTCCTTTCCGAGGGTCTTAAGCTTGTTGACAAATTCC TGGAAGATGTCAAAAAACTCTATCATTCTGAAGCTTTCAC CGTTAACTTCGGCGACACCGAAGAGGCAAAAAAGCAGAT CAACGACTACGTAGAGAAGGTACCCAAGGTAAGATTGT TGACCTGGTTAAAGAACTCGATCGCGACACCGTCTTTGCT CTGGTTAACTACATCTTCTTTAAGGGCAAATGGGAGCGCC CGTTCGAAGTTAAAGACACCGAAGAGGAAGATTTTCACG TTGATCAGGTTACCACCGTTAAGGTCCCTATGATGAAACG TCTGGGTATGTTCAACATCCAGCACTGTAAGAAACTCTCC TCTTGGGTTCTTCTGATGAAATACCTGGGTAACGCGACTG CTATCTTTTTCCTTCCGGACGAAGGTAAACTGCAGCATCT CGAAAATGAGCTTACTCACGACATCATCACCAAATTTCTG GAAAACGAGGATCGCCGTTCTGCTTCTCTGCACCTGCCTA AGCTGTCCATTACTGGTACTTATGACCTGAAATCTGTTCT GGGCCAACTGGGCATTACCAAGGTGTTTTCTAACGGTGCT GACCTTTCTGGCGTTACTGAGGAGGCTCCGCTGAAACTGT CTAAAGCTGTGCACAAAGCAGTTCTCACCATTGACGAAA AAGGTACCGAAGCAGCAGGTGCGATGTTCCTCGAAGCTA TCCCGATGTCTATCCCTCCGGAAGTGAAATTCAATAAACC GTTCGTTTTCCTGATGATCGAGCAGAATACCAAGTCTCCG CTGTTCATGGGTAAAGTTGTTAATCCAACCCAGAAAGGA GGTACTTCTACTGAACCGTCTGAAGGCAGCGCACCAGGT AGCGAACCGGCTACTTCCGGTTCTGAAACCCCAGGTAGC CCAGCAGGTTCTCCAACTTCTACTGAAGAAGGTTCTACCA GCTCTACCGCAGAATCTCCTGGTCCAGGTACCTCTACTCC GGAAAGCGGCTCTGCATCTCCAGGTTCTACTAGCGAATCT CCTTCTGGCACTGCACCAGGTTCTACTAGCGAATCCCCGT CTGGTACTGCTCCAGGTACTTCTACTCCTGAAAGCGGTTC CGCTTCTCCAGGTACCTCTACTCCGGAAAGCGGTTCTGCA TCTCCAGGTAGCGAACCGGCAACCTCCGGCTCTGAAACC CCAGGTACCTCTGAAAGCGCTACTCCTGAATCCGGCCCA GGTAGCCCGGCAGGTTCTCCGACTTCCACTGAGGAAGGT ACCTCTACTGAACCTTCTGAGGGCAGCGCTCCAGGTACTT CTGAAAGCGCTACCCCGGAGTCCGGTCCAGGTACTTCTAC TGAACCGTCCGAAGGTAGCGCACCAGGTACTTCTACCGA ACCGTCCGAGGGTAGCGCACCAGGTAGCCCAGCAGGTTC TCCTACCTCCACCGAGGAAGGTACTTCTACCGAACCGTCC GAGGGTAGCGCACCAGGTACTTCTACCGAACCTTCCGAG GGCAGCGCACCAGGTACTTCTGAAAGCGCTACCCCTGAG TCCGGCCCAGGTACTTCTGAAAGCGCTACTCCTGAATCCG GTCCAGGTACCTCTACTGAACCTTCCGAAGGCAGCGCTCC AGGTACCTCTACCGAACCGTCCGAGGGCAGCGCACCAGG TACTTCTGAAAGCGCAACCCCTGAATCCGGTCCAGGTACT TCTACTGAACCTTCCGAAGGTAGCGCTCCAGGTAGCGAA CCTGCTACTTCTGGTTCTGAAACCCCAGGTAGCCCGGCTG GCTCTCCGACCTCCACCGAGGAAGGTAGCTCTACCCCGTC TGGTGCTACTGGTTCTCCAGGTACTCCGGGCAGCGGTACT GCTTCTTCCTCTCCAGGTAGCTCTACCCCTTCTGGTGCTAC TGGCTCTCCAGGTACCTCTACCGAACCGTCCGAGGGTAGC GCACCAGGTACCTCTACTGAACCGTCTGAGGGTAGCGCT CCAGGTAGCGAACCGGCAACCTCCGGTTCTGAAACTCCA GGTAGCCCTGCTGGCTCTCCGACTTCTACTGAGGAAGGTA GCCCGGCTGGTTCTCCGACTTCTACTGAGGAAGGTACTTC | 698 | MAEDPQGDAAQK TDTSHHDQDHPTF NKITPNLAEFAFSL YRQLAHQSNSTNI FFSPVSIATAFAML SLGTKADTHDEIL EGLNFNLTEIPEAQ IHEGFQELLRTLNQ PDSQLQLTTGNGL FLSEGLKLVDKFL EDVKKLYHSEAFT VNFGDTEEAKKQI NDYVEKGTQGKIV DLVKELDRDTVFA LVNYIFFKGKWER PFEVKDTEEEDFH VDQVTTVKVPMM KRLGMFNIQHCKK LSSWVLLMKYLG NATAIFFLPDEGKL QHLENELTHDIITK FLENEDRRSASLH LPKLSITGTYDLKS VLGQLGITKVFSN GADLSGVTEEAPL KLSKAVHKAVLTI DEKGTEAAGAMF LEAIPMSIPPEVKF NKPVFLMIEQNT KSPLFMGKVVNPT QKGGTSTEPSEGS APGSEPATSGSETP GSPAGSPTSTEEGS TSSTAESPGPGTST PESGSASPGSTSES PSGTAPGSTSESPS GTAPGTSTPESGSA SPGTSTPESGSASP GSEPATSGSETPGT SESATPESGPGSPA GSPTSTEEGTSTEP SEGSAPGTSESATP ESGPGTSTEPSEGS APGTSTEPSEGSAP GSPAGSPTSTEEGT STEPSEGSAPGTST EPSEGSAPGTSESA TPESGPGTSESATP ESGPGTSTEPSEGS APGTSTEPSEGSAP GTSESATPESGPGT STEPSEGSAPGSEP ATSGSETPGSPAGS PTSTEEGSSTPSGA TGSPGTPGSGTASS SPGSSTPSGATGSP GTSTEPSEGSAPGT STEPSEGSAPGSEP ATSGSETPGSPAGS PTSTEEGSPAGSPT STEEGTSTEPSEGS APGASASGAPSTG | 699 |

TABLE 22-continued aaT-XTEN DNA and amino acid sequences of Examples 22-23

| Clone Name | DNA Sequence | SEQ ID NO: | Amino Acid Sequence | SEQ ID NO: |
|---|---|---|---|---|
| | TACCGAACCTTCCGAAGGTAGCGCTCCAGGTGCAAGCGC<br>AAGCGGCGCGCCAAGCACGGGAGGTACTTCTGAAAGCGC<br>TACTCCTGAGTCCGGCCCAGGTAGCCCGGCTGGCTCTCCG<br>ACTTCCACCGAGGAAGGTAGCCCGGCTGGCTCTCCAACTT<br>CTACTGAAGAAGGTTCTACCAGCTCTACCGCTGAATCTCC<br>TGGCCCAGGTTCTACTAGCGAATCTCCGTCTGGCACCGCA<br>CCAGGTACTTCCCCTAGCGGTGAATCTTCTACTGCACCAG<br>GTACCCCTGGCAGCGGTACCGCTTCTTCCTCTCCAGGTAG<br>CTCTACCCCGTCTGGTGCTACTGGCTCTCCAGGTTCTAGC<br>CCGTCTGCATCTACCGGTACCGGCCCAGGTAGCGAACCG<br>GCAACCTCCGGCTCTGAAACTCCAGGTACTTCTGAAAGC<br>GCTACTCCGGAATCCGGCCCAGGTAGCGAACCGGCTACT<br>TCCGGCTCTGAAACCCCAGGTTCCACCAGCTCTACTGCAG<br>AATCTCCGGGCCCAGGTTCTACTAGCTCTACTGCAGAATC<br>TCCGGGTCCAGGTACTTCTCCTAGCGGCGAATCTTCTACC<br>GCTCCAGGTAGCGAACCGGCAACCTCTGGCTCTGAAACT<br>CCAGGTAGCGAACCTGCAACCTCCGGCTCTGAAACCCCA<br>GGTACTTCTACTGAACCTTCTGAGGGCAGCGCACCAGGTT<br>CTACCAGCTCTACCGCAGAATCTCCTGGTCCAGGTACCTC<br>TACTCCGGAAAGCGGCTCTGCATCTCCAGGTTCTACTAGC<br>GAATCTCCTTCTGGCACTGCACCAGGTACTTCTACCGAAC<br>CGTCCGAAGGCAGCGCTCCAGGTACCTCTACTGAACCTTC<br>CGAGGGCAGCGCTCCAGGTACCTCTACCGAACCTTCTGA<br>AGGTAGCGCACCAGGTAGCTCTACTCCGTCTGGTGCAAC<br>CGGCTCCCCAGGTTCTAGCCCGTCTGCTTCCACTGGTACT<br>GGCCCAGGTGCTTCCCCGGGCACCAGCTCTACTGGTTCTC<br>CAGGTAGCGAACCTGCTACCTCCGGTTCTGAAACCCCAG<br>GTACCTCTGAAAGCGCAACTCCGGAGTCTGGTCCAGGTA<br>GCCCTGCAGGTTCTCCTACCTCCACTGAGGAAGGTAGCTC<br>TACTCCGTCTGGTGCAACCGGCTCCCCAGGTTCTAGCCCG<br>TCTGCTTCCACTGGTACTGGCCCAGGTGCTTCCCCGGGCA<br>CCAGCTCTACTGGTTCTCCAGGTACCTCTGAAAGCGCTAC<br>TCCGGAGTCTGGCCCAGGTACCTCTACTGAACCGTCTGAG<br>GGTAGCGCTCCAGGTACTTCTACTGAACCGTCCGAAGGT<br>AGCGCACCAGGTTAAACTAGTTAA | | GTSESATPESGPGS<br>PAGSPTSTEEGSPA<br>GSPTSTEEGSTSST<br>AESPGPGSTSESPS<br>GTAPGTSPSGESST<br>APGTPGSGTASSSP<br>GSSTPSGATGSPGS<br>SPSASTGTGPGSEP<br>ATSGSETPGTSESA<br>TPESGPGSEPATSG<br>SETPGSTSSTAESP<br>GPGSTSSTAESPGP<br>GTSPSGESSTAPGS<br>EPATSGSETPGSEP<br>ATSGSETPGTSTEP<br>SEGSAPGSTSSTAE<br>SPGPGTSTPESGSA<br>SPGSTSESPSGTAP<br>GTSTEPSEGSAPGT<br>STEPSEGSAPGTST<br>EPSEGSAPGSSTPS<br>GATGSPGSSPSAST<br>GTGPGASPGTSST<br>GSPGSEPATSGSET<br>PGTSESATPESGPG<br>SPAGSPTSTEEGSS<br>TPSGATGSPGSSPS<br>ASTGTGPGASPGT<br>SSTGSPGTSESATP<br>ESGPGTSTEPSEGS<br>APGTSTEPSEGSAP | |
| AM923-<br>aaT,<br>(AC346) | ATGGCTGAACCTGCTGGCTCTCCAACCTCCACTGAGGAA<br>GGTGCATCCCCGGGCACCAGCTCTACCGGTTCTCCAGGTA<br>GCTCTACCCCGTCTGGTGCTACCGGCTCTCCAGGTAGCTC<br>TACCCCGTCTGGTGCTACTGGCTCTCCAGGTACTTCTACT<br>GAACCGTCTGAAGGCAGCGCACCAGGTAGCGAACCGGCT<br>ACTTCCGGTTCTGAAACCCCAGGTAGCCCAGCAGGTTCTC<br>CAACTTCTACTGAAGAAGGTTCTACCAGCTCTACCGCAGA<br>ATCTCCTGGTCCAGGTACCTCTACTCCGGAAAGCGGCTCT<br>GCATCTCCAGGTTCTACTAGCGAATCTCCTTCTGGCACTG<br>CACCAGGTTCTACTAGCGAATCCCGTCTGGTACTGCTCC<br>AGGTACTTCTACTCCTGAAAGCGGTTCCGCTTCTCCAGGT<br>ACCTCTACTCCGGAAAGCGGTTCTGCATCTCCAGGTAGCG<br>AACCGGCAACCTCCGGCTCTGAAACCCCAGGTACCTCTG<br>AAAGCGCTACTCCTGAATCCGGCCCAGGTAGCCCGGCAG<br>GTTCTCCGACTTCCACTGAGGAAGGTACCTCTACTGAACC<br>TTCTGAGGGCAGCGCTCCAGGTACTTCTGAAAGCGCTACC<br>CCGGAGTCCGGTCCAGGTACTTCTACTGAACCGTCCGAA<br>GGTAGCGCACCAGGTACTTCTACCGAACCGTCCGAGGGT<br>AGCGCACCAGGTAGCCCAGCAGGTTCTCCTACCTCCACC<br>GAGGAAGGTACTTCTACCGAACCGTCCGAGGGTAGCGCA<br>CCAGGTACTTCTACCGAACCTTCCGAGGGCAGCGCTCACCA<br>GGTACTTCTGAAAGCGCTACCCCTGAGTCCGGCCCAGGT<br>ACTTCTGAAAGCGCTACTCCTGAATCCGGTCCAGGTACCT<br>CTACTGAACCTTCCGAAGGCAGCGCTCCAGGTACCTCTAC<br>CGAACCGTCTGAGGGCAGCGCACCAGGTACTTCTGAAAG<br>CGCAACCCCTGAATCCGGTCCAGGTACTTCTACTGAACCT<br>TCCGAAGGTAGCGCTCCAGGTAGCGAACCTGCTACTTCTG<br>GTTCTGAAACCCCAGGTAGCCCGGCTGGCTCTCCGACCTC<br>CACCGAGGAAGGTACTCTACCCCGTCTGGTGCTACTGGT<br>TCTCCAGGTACTCCGGGCAGCGGTACTGCTTCTTCCTCTC<br>CAGGTAGCTCTACCCCTTCTGGTGCTACTGGCTCTCCAGG<br>TACCTCTACCGAACCGTCCGAGGGTAGCGCACCAGGTAC<br>CTCTACTGAACCGTCTGAGGGTAGCGCTCCAGGTAGCGA<br>ACCGGCAACCTCCGGTTCTGAAACTCCAGGTAGCCCTGCT<br>GGCTCTCCGACTTCTACTGAGGAAGGTAGCCCGGCTGTT<br>CTCCGACTTCTACTGAGGAAGGTACTTCTACCGAACCTTC<br>CGAAGGTAGCGCTCCAGGTGCAAGCGCAAGCGGCGCGCC<br>AAGCACGGGAGGTACTTCTGAAAGCGCTACTCCTGAGTC | 700 | MAEPAGSPTSTEE<br>GASPGTSSTGSPGS<br>STPSGATGSPGSST<br>PSGATGSPGTSTEP<br>SEGSAPGSEPATSG<br>SETPGSPAGSPTST<br>EEGSTSSTAESPGP<br>GTSTPESGSASPGS<br>TSESPSGTAPGSTS<br>ESPSGTAPGTSTPE<br>SGSASPGTSTPESG<br>SASPGSEPATSGSE<br>TPGTSESATPESGP<br>GSPAGSPTSTEEGT<br>STEPSEGSAPGTSE<br>SATPESGPGTSTEP<br>SEGSAPGTSTEPSE<br>GSAPGSPAGSPTST<br>EEGTSTEPSEGSAP<br>GTSTEPSEGSAPGT<br>SESATPESGPGTSE<br>SATPESGPGTSTEP<br>SEGSAPGTSTEPSE<br>GSAPGTSESATPES<br>GPGTSTEPSEGSAP<br>GSEPATSGSETPGS<br>PAGSPTSTEEGSST<br>PSGATGSPGTPGS<br>GTASSSPGSSTPSG<br>ATGSPGTSTEPSEG<br>SAPGTSTEPSEGSA<br>PGSEPATSGSETPG<br>SPAGSPTSTEEGSP<br>AGSPTSTEEGTSTE<br>PSEGSAPGASASG<br>APSTGGTSESATPE<br>SGPGSPAGSPTSTE<br>EGSPAGSPTSTEEG | 701 |

TABLE 22-continued aaT-XTEN DNA and amino acid sequences of Examples 22-23

| Clone Name | DNA Sequence | SEQ ID NO: | Amino Acid Sequence | SEQ ID NO: |
|---|---|---|---|---|
| | CGGCCCAGGTAGCCCGGCTGGCTCTCCGACTTCCACCGA<br>GGAAGGTAGCCCGGCTGGCTCTCCAACTTCTACTGAAGA<br>AGGTTCTACCAGCTCTACCGCTGAATCCTGGCCCAGGT<br>TCTACTAGCGAATCTCCGTCTGGCACCGCACCAGGTACTT<br>CCCCTAGCGGTGAATCTTCTACTGCACCAGGTACCCCTGG<br>CAGCGGTACCGCTTCTTCCTCTCCAGGTAGCTCTACCCCG<br>TCTGGTGCTACTGGCTCTCCAGGTTCTAGCCCGTCTGCAT<br>CTACCGGTACCGGCCCAGGTAGCGAACCGGCAACCTCCG<br>GCTCTGAAACTCCAGGTACTTCTGAAAGCGCTACTCCGGA<br>ATCCGGCCCAGGTAGCGAACCGGCTACTTCCGGCTCTGA<br>AACCCCAGGTTCCACCAGCTCTACTGCAGAATCTCCGGGC<br>CCAGGTTCTACTAGCTCTACTGCAGAATCTCCGGGTCCAG<br>GTACTTCTCCTAGCGGCGAATCTTCTACCGCTCCAGGTAG<br>CGAACCGGCAACCTCTGGCTCTGAAACTCCAGGTAGCGA<br>ACCTGCAACCTCCGGCTCTGAAACCCCAGGTACTTCTACT<br>GAACCTTCTGAGGGCAGCGCACCAGGTTCTACCAGCTCT<br>ACCGCAGAATCTCCTGGTCCAGGTACCTCTACTCCGGAAA<br>GCGGCTCTGCATCTCCAGGTTCTACTAGCGAATCTCCTTC<br>TGGCACTGCACCAGGTACTTCTACCGAACCGTCCGAAGG<br>CAGCGCTCCAGGTACCTCTACTGAACCTTCCGAGGGCAG<br>CGCTCCAGGTACCTCTACCGAACCTTCTGAAGGTAGCGCA<br>CCAGGTAGCTCTACTCCGTCTGGTGCAACCGGCTCCCAG<br>GTTCTAGCCCGTCTGCTTCCACTGGTACTGGCCCAGGTGC<br>TTCCCCGGGCACCAGCTCTACTGGTTCTCCAGGTAGCGAA<br>CCTGCTACCTCCGGTTCTGAAACCCCAGGTACCTCTGAAA<br>GCGCAACTCCGGAGTCTGGTCCAGGTAGCCCTGCAGGTT<br>CTCCTACCTCCACTGAGGAAGGTAGCTCTACTCCGTCTGG<br>TGCAACCGGCTCCCCAGGTTCTAGCCCGTCTGCTTCCACT<br>GGTACTGGCCCAGGTGCTTCCCCGGGCACCAGCTCTACTG<br>GTTCTCCAGGTACCTCTGAAAGCGCTACTCCGGAGTCTGG<br>CCCAGGTACCTCTACTGAACCGTCTGAGGGTAGCGCTCCA<br>GGTACTTCTACTGAACCGTCCGAAGGTAGCGCACCAGGT<br>GAAGACCCGCAGGGTGACGCGGCACAGAAAACCGACAC<br>CTCTCACCACGACCAAGACCACCCTACCTTCAACAAAATC<br>ACCCCGAACCTGGCGGAATTCGCATTCTCCCTCTATCGTC<br>AGCTGGCTCACCAGTCTAACTCCACTAACATTTTCTTCTC<br>CCCGGTTTCTATCGCTACCGCATTCGCTATGCTCTCTCTTG<br>GCACTAAAGCTGACACCCACGACGAGATTCTTGAGGGTC<br>TTAACTTCAATCTGACCGAAATCCCGGAGGCTCAGATCCA<br>CGAGGGCTTTCAGGAACTGCTGCGTACCCTGAATCAACCT<br>GATTCTCAACTGCAACTTACTACCGGTAACGGTCTGTTCC<br>TTTCCGAGGGTCTTAAGCTTGTTGACAAATTCCTGGAAGA<br>TGTCAAAAAACTCTATCATTCTGAAGCTTTCACCGTTAAC<br>TTCGGCGACACCGAAGAGGCAAAAAAGCAGATCAACGA<br>CTACGTAGAGAAAGGTACCCAAGGTAAGATTGTTGACCT<br>GGTTAAAGAACTCGATCGCGACACCGTCTTTGCTCTGGTT<br>AACTACATCTTCTTTAAGGGCAAATGGGAGCGCCCGTTCG<br>AAGTTAAAGACACCGAAGAGGAAGATTTTCACGTTGATC<br>AGGTTACCACCGTTAAGGTCCCTATGATGAAACGTCTGG<br>GTATGTTCAACATCCAGCACTGTAAGAAACTCTCCTCTTG<br>GGTTCTTCTGATGAAATACCTGGGTAACGCGACTGCTATC<br>TTTTTCCTTCCGGACGAAGGTAAACTGCAGCATCTCGAAA<br>ATGAGCTTACTCACGACATCATCACCAAATTTCTGGAAAA<br>CGAGGATCGCCGTTCTGCTTCTCTGCACCTGCCTAAGCTG<br>TCCATTACTGGTACTTATGACCTGAAATCTGTTCTGGGCC<br>AACTGGGCATTACAAGGTGTTTTCTAACGGTGCTGACCT<br>TTCTGGCGTTACTGAGGAGGCTCCGCTGAAACTGTCTAAA<br>GCTGTGCACAAAGCAGTTCTCACCATTGACGAAAAAGGT<br>ACCGAAGCAGCAGGTGCGATGTTCCTGAAGCTATCCCG<br>ATGTCTATCCCTCCGGAAGTGAAATTCAATAAACCGTTCG<br>TTTTCCTGATGATCGAGCAGAATACCAAGTCTCCGCTGTT<br>CATGGGTAAAGTTGTTAATCCAACCCAGAAATAA | | STSSTAESPGPGST<br>SESPSGTAPGTSPS<br>GESSTAPGTPGSGT<br>ASSSPGSSTPSGAT<br>GSPGSSPSASTGTG<br>PGSEPATSGSETPG<br>TSESATPESGPGSE<br>PATSGSETPGSTSS<br>TAESPGPGSTSSTA<br>ESPGPGTSPSGESS<br>TAPGSEPATSGSET<br>PGSEPATSGSETPG<br>TSTEPSEGSAPGST<br>SSTAESPGPGTSTP<br>ESGSASPGSTSESP<br>SGTAPGTSTEPSEG<br>SAPGTSTEPSEGSA<br>PGTSTEPSEGSAPG<br>SSTPSGATGSPGSS<br>PSASTGTGPGASP<br>GTSSTGSPGSEPAT<br>SGSETPGTSESATP<br>ESGPGSPAGSPTST<br>EEGSSTPSGATGSP<br>GSSPSASTGTGPG<br>ASPGTSSTGSPGTS<br>ESATPESGPGTSTE<br>PSEGSAPGTSTEPS<br>EGSAPGEDPQGDA<br>AQKTDTSHHDQD<br>HPTFNKITPNLAEF<br>AFSLYRQLAHQSN<br>STNIFFSPVSIATAF<br>AMLSLGTKADTH<br>DEILEGLNFNLTEI<br>PEAQIHEGFQELLR<br>TLNQPDSQLQLTT<br>GNGLFLSEGLKLV<br>DKFLEDVKKLYHS<br>EAFTVNFGDTEEA<br>KKQINDYVEKGTQ<br>GKIVDLVKELDRD<br>TVFALVNYIFFKG<br>KWERPFEVKDTEE<br>EDFHVDQVTTVK<br>VPMMKRLGMFNI<br>QHCKKLSSWVLL<br>MKYLGNATAIFFL<br>PDEGKLQHLENEL<br>THDIITKFLENEDR<br>RSASLHLPKLSITG<br>TYDLKSVLGQLGI<br>TKVFSNGADLSGV<br>TEEAPLKLSKAVH<br>KAVLTIDEKGTEA<br>AGAMFLEAIPMSIP<br>PEVKFNKPFVFLMI<br>EQNTKSPLFMGKV<br>VNPTQK | |
| aaT-AE288 | ATGGCTGAAGATCCTCAGGGCGATGCTGCTCAAAAAACC<br>GACACCTCTCACCATGATCAGGACCATCCGACTTTTAACA<br>AAATCACCCCGAACCTGGCGGAATTCGCATTCTCCCTCTA<br>TCGTCAGCTGGCTCACCAGTCTAACTCCACTAACATTTTC<br>TTCTCCCCGGTTTCTATCGCTACCGCATTCGCTATGCTCTC<br>TCTTGGCACTAAAGCTGACACCCACGACGAGATTCTTGA<br>GGGTCTTAACTTCAATCTGACCGAAATCCCGGAGGCTCA<br>GATCCACGAGGGCTTTCAGGAACTGCTGCGTACCCTGAA<br>TCAACCTGATTCTCAACTGCAACTTACTACCGGTAACGGT<br>CTGTTCCTTTCCGAGGGTCTTAAGCTTGTTGACAAATTCC<br>TGGAAGATGTCAAAAAACTCTATCATTCTGAAGCTTTCAC | 702 | MAEDPQGDAAQK<br>TDTSHHDQDHPTF<br>NKITPNLAEFAFSL<br>YRQLAHQSNSTNI<br>FFSPVSIATAFAML<br>SLGTKADTHDEIL<br>EGLNFNLTEIPEAQ<br>IHEGFQELLRTLNQ<br>PDSQLQLTTGNGL<br>FLSEGLKLVDKFL<br>EDVKKLYHSEAFT | 703 |

TABLE 22-continued aaT-XTEN DNA and amino acid sequences of Examples 22-23

| Clone Name | DNA Sequence | SEQ ID NO: | Amino Acid Sequence | SEQ ID NO: |
|---|---|---|---|---|
| | CGTTAACTTCGGCGACACCGAAGAGGCAAAAAAGCAGAT<br>CAACGACTACGTAGAGAAAGGTACCCAAGGTAAGATTGT<br>TGACCTGGTTAAAGAACTCGATCGCGACACCGTCTTTGCT<br>CTGGTTAACTACATCTTCTTTAAGGGCAAATGGGAGCGCC<br>CGTTCGAAGTTAAAGACACCGAAGAGGAAGATTTTCACG<br>TTGATCAGGTTACCACCGTTAAGGTCCCTATGATGAAACG<br>TCTGGGTATGTTCAACATCCAGCACTGTAAGAAACTCTCC<br>TCTTGGGTTCTTCTGATGAAATACCTGGGTAACGCGACTG<br>CTATCTTTTTCCTTCCGGACGAAGGTAAACTGCAGCATCT<br>CGAAAATGAGCTTACTCACGACATCATCACCAAATTTCTG<br>GAAAACGAGGATCGCCGTTCTGCTTCTCTGCACCTGCCTA<br>AGCTGTCCATTACTGGTACTTATGACCTGAAATCTGTTCT<br>GGGCCAACTGGGCATTACCAAGGTGTTTTCTAACGGTGCT<br>GACCTTTCTGGCGTTACTGAGGAGGCTCCGCTGAAACTGT<br>CTAAAGCTGTGCACAAAGCAGTTCTCACCATTGACGAAA<br>AAGGTACCGAAGCAGCAGGTGCGATGTTCCTCGAAGCTA<br>TCCCGATGTCTATCCCTCCGGAAGTGAAATTCAATAAACC<br>GTTCGTTTTCCTGATGATCGAGCAGAATACCAAGTCTCCG<br>CTGTTCATGGGTAAAGTTGTTAATCCAACCCAGAAAGGA<br>GGTAGCCCTGCTGGCTCTCCGACTTCTACTGAGGAAGGTA<br>GCCCGGCTGGTTCTCCGACTTCTACTGAGGAAGGTACTTC<br>TACCGAACCTTCCGAAGGTAGCGCTCCAGGTAGCGAACC<br>GGCAACCTCCGGCTCTGAAACCCCAGGTACCTCTGAAAG<br>CGCTACTCCTGAATCCGGCCCAGGTAGCCCGGCAGGTTCT<br>CCgACTTCCACTGAGGAAGGTAGCCCGGCTGGTTCTCCgA<br>CTTCCACCGAGGAAGGTACCTCTACTGAACCTTCTGAGGG<br>TAGCGCTCCAGGTACCTCTACTGAACCTTCCgAAGGCAGC<br>GCTCCAGGTAGCGAACCGGCAACCTCCGGCTCTGAAACT<br>CCAGGTACTTCTGAAAGCGCTACTCCGGAATCCGGCCCA<br>GGTAGCGAACCGGCTACTTCCGGCTCTGAAACCCCAGGT<br>ACTTCTACTGAACCTTCCgAAGGTAGCGCTCCAGGTAGCG<br>AACCTGCTACTTCTGGTTCTGAAACCCCAGGTAGCCCGGC<br>TGGcTCTCCGACCTCCACCGAGGAAGGTACCTCTACCGAA<br>CCGTCTGAAGGTAGCGCACCAGGTACCTCTGAAAGCGCA<br>ACTCCTGAGTCCGGTCCAGGTACTTCTGAAAGCGCAACCC<br>CGGAGTCTGGCCCAGGTAGCGAACCTGCAACCTCTGGCT<br>CTGAAACCCCAGGTACCTCTGAAAGCGCTACTCCTGAATC<br>TGGCCCAGGTACTTCTACTGAACCGTCCGAGGGCAGCGC<br>ACCAGGTACTTCTGAAAGCGCAACCCCTGAATCCGGTCC<br>AGGTAGCGAACCGGCTACTTCTGGCTCTGAGACTCCAGG<br>TACTTCTACCGAACCGTCcGAAGGTAGCGCACCAGGTTAA | | VNFGDTEEAKKQI<br>NDYVEKGTQGKIV<br>DLVKELDRDTVFA<br>LVNYIFFKGKWER<br>PFEVKDTEEEDFH<br>VDQVTTVKVPMM<br>KRLGMFNIQHCKK<br>LSSWVLLMKYLG<br>NATAIFFLPDEGKL<br>QHLENELTHDIITK<br>FLENEDRRSASLH<br>LPKLSITGTYDLKS<br>VLGQLGITKVFSN<br>GADLSGVTEEAPL<br>KLSKAVHKAVLTI<br>DEKGTEAAGAMF<br>LEAIPMSIPPEVKF<br>NKPFVFLMIEQNT<br>KSPLFMGKVVNPT<br>QKGGSPAGSPTST<br>EEGSPAGSPTSTEE<br>GTSTEPSEGSAPGS<br>EPATSGSETPGTSE<br>SATPESGPGSPAGS<br>PTSTEEGSPAGSPT<br>STEEGTSTEPSEGS<br>APGTSTEPSEGSAP<br>GSEPATSGSETPGT<br>SESATPESGPGSEP<br>ATSGSETPGTSTEP<br>SEGSAPGSEPATSG<br>SETPGSPAGSPTST<br>EEGTSTEPSEGSAP<br>GTSESATPESGPGT<br>SESATPESGPGSEP<br>ATSGSETPGTSESA<br>TPESGPGTSTEPSE<br>GSAPGTSESATPES<br>GPGSEPATSGSETP<br>GTSTEPSEGSAPG | |
| aaT-XTEN_AE576, DNA | ATGGCTGAAGATCCTCAGGGCGATGCTGCTCAAAAAACC<br>GACACCTCTCACCATGATCAGGACCTTCCGACTTTTAACA<br>AAATCACCCCGAACCTGGCGGAATTCGCATTCTCCCTCTA<br>TCGTCAGCTGGCTCACCAGTCTAACTCCACTAACATTTTC<br>TTCTCCCCGGTTTCTATCGCTACCGCATTCGCTATGCTCTC<br>TCTTGGCACTAAAGCTGACACCCACGACGAGATTCTTGA<br>GGGTCTTAACTTCAATCTGACCGAAATCCCGGAGGCTCA<br>GATCCACGAGGGCTTTCAGGAACTGCTGCGTACCCTGAA<br>TCAACCTGATTCTCAACTGCAACTTACTACCGGTAACGGT<br>CTGTTCCTTTCCGAGGGTCTTAAGCTTGTTGACAAATTCC<br>TGGAAGATGTCAAAAAACTCTATCATTCTGAAGCTTTCAC<br>CGTTAACTTCGGCGACACCGAAGAGGCAAAAAAGCAGAT<br>CAACGACTACGTAGAGAAAGGTACCCAAGGTAAGATTGT<br>TGACCTGGTTAAAGAACTCGATCGCGACACCGTCTTTGCT<br>CTGGTTAACTACATCTTCTTTAAGGGCAAATGGGAGCGCC<br>CGTTCGAAGTTAAAGACACCGAAGAGGAAGATTTTCACG<br>TTGATCAGGTTACCACCGTTAAGGTCCCTATGATGAAACG<br>TCTGGGTATGTTCAACATCCAGCACTGTAAGAAACTCTCC<br>TCTTGGGTTCTTCTGATGAAATACCTGGGTAACGCGACTG<br>CTATCTTTTTCCTTCCGGACGAAGGTAAACTGCAGCATCT<br>CGAAAATGAGCTTACTCACGACATCATCACCAAATTTCTG<br>GAAAACGAGGATCGCCGTTCTGCTTCTCTGCACCTGCCTA<br>AGCTGTCCATTACTGGTACTTATGACCTGAAATCTGTTCT<br>GGGCCAACTGGGCATTACCAAGGTGTTTTCTAACGGTGCT<br>GACCTTTCTGGCGTTACTGAGGAGGCTCCGCTGAAACTGT<br>CTAAAGCTGTGCACAAAGCAGTTCTCACCATTGACGAAA<br>AAGGTACCGAAGCAGCAGGTGCGATGTTCCTCGAAGCTA<br>TCCCGATGTCTATCCCTCCGGAAGTGAAATTCAATAAACC<br>GTTCGTTTTCCTGATGATCGAGCAGAATACCAAGTCTCCG<br>CTGTTCATGGGTAAAGTTGTTAATCCAACCCAGAAAGGA<br>GGTAGCCCGGCTGGCTCTCCGACCTCTACTGAGGAAGGTA<br>CTTCTGAAAGCGCTACTCCTGAGTCTGGTCCAGGTACCTC | 704 | MAEDPQGDAAQK<br>TDTSHHDQDHPTF<br>NKITPNLAEFAFSL<br>YRQLAHQSNSTNI<br>FFSPVSIATAFAML<br>SLGTKADTHDEIL<br>EGLNFNLTEIPEAQ<br>IHEGFQELLRTLNQ<br>PDSQLQLTTGNGL<br>FLSEGLKLVDKFL<br>EDVKKLYHSEAFT<br>VNFGDTEEAKKQI<br>NDYVEKGTQGKIV<br>DLVKELDRDTVFA<br>LVNYIFFKGKWER<br>PFEVKDTEEEDFH<br>VDQVTTVKVPMM<br>KRLGMFNIQHCKK<br>LSSWVLLMKYLG<br>NATAIFFLPDEGKL<br>QHLENELTHDIITK<br>FLENEDRRSASLH<br>LPKLSITGTYDLKS<br>VLGQLGITKVFSN<br>GADLSGVTEEAPL<br>KLSKAVHKAVLTI<br>DEKGTEAAGAMF<br>LEAIPMSIPPEVKF<br>NKPFVFLMIEQNT<br>KSPLFMGKVVNPT<br>QKGGSPAGSPTST<br>EEGTSESATPESGP | 705 |

TABLE 22-continued aaT-XTEN DNA and amino acid sequences of Examples 22-23

| Clone Name | DNA Sequence | SEQ ID NO: | Amino Acid Sequence | SEQ ID NO: |
|---|---|---|---|---|
| | TACTGAACCGTCCGAAGGTAGCGCTCCAGGTAGCCCAGC | | GTSTEPSEGSAPGS | |
| | AGGCTCTCCGACTTCCACTGAGGAAGGTACTTCTACTGAA | | PAGSPTSTEEGTST | |
| | CCTTCCGAAGGCAGCGCACCAGGTACCTCTACTGAACCTT | | EPSEGSAPGTSTEP | |
| | CTGAGGGCAGCGCTCCAGGTACTTCTGAAAGCGCTACCC | | SEGSAPGTSESATP | |
| | CGGAATCTGGCCCAGGTAGCGAACCGGCTACTTCTGGTTC | | ESGPGSEPATSGSE | |
| | TGAAACCCCAGGTAGCGAACCGGCTACCTCCGGTTCTGA | | TPGSEPATSGSETP | |
| | AACTCCAGGTAGCCCGGCAGGCTCTCCGACCTCTACTGA | | GSPAGSPTSTEEGT | |
| | GGAAGGTACTTCTGAAAGCGCAACCCCGGAGTCCGGCCC | | SESATPESGPGTST | |
| | AGGTACCTCTACCGAACCGTCTGAGGGCAGCGCACCAGG | | EPSEGSAPGTSTEP | |
| | TACTTCTACCGAACCGTCCGAGGGTAGCGCACCAGGTAG | | SEGSAPGSPAGSPT | |
| | CCCAGCAGGTTCTCCTACCTCCACCGAGGAAGGTACTTCT | | STEEGTSTEPSEGS | |
| | ACCGAACCGTCCGAGGGTAGCGCACCAGGTACCTCTACT | | APGTSTEPSEGSAP | |
| | GAACCTTCTGAGGGCAGCGCTCCAGGTACTTCTGAAAGC | | GTSESATPESGPGT | |
| | GCTACCCCGGAGTCCGGTCCAGGTACTTCTACTGAACCGT | | STEPSEGSAPGTSE | |
| | CCGAAGGTAGCGCACCAGGTACTTCTGAAAGCGCAACCC | | SATPESGPGSEPAT | |
| | CTGAATCCGGTCCAGGTAGCGAACCGGCTACTTCTGGCTC | | SGSETPGTSTEPSE | |
| | TGAGACTCCAGGTACTTCTACCGAACCGTCCGAAGGTAG | | GSAPGTSTEPSEGS | |
| | CGCACCAGGTACTTCTACTGAACCGTCTGAAGGTAGCGC | | APGTSESATPESGP | |
| | ACCAGGTACTTCTGAAAGCGCAACCCCGGAATCCGGCCC | | GTSESATPESGPGS | |
| | AGGTACCTCTGAAAGCGCAACCCCGGAGTCCGGCCCAGG | | PAGSPTSTEEGTSE | |
| | TAGCCCTGCTGGCTCTCCAACCTCCACCGAAGAAGGTACC | | SATPESGPGSEPAT | |
| | TCTGAAAGCGCAACCCCTGAATCCGGCCCAGGTAGCGAA | | SGSETPGTSESATP | |
| | CCGGCAACCTCCGGTTCTGAAACCCCAGGTACCTCTGAA | | ESGPGTSTEPSEGS | |
| | AGCGCTACTCCGGAGTCTGGCCCAGGTACCTCTACTGAAC | | APGTSTEPSEGSAP | |
| | CGTCTGAGGGTAGCGCTCCAGGTACTTCTACTGAACCGTC | | GTSTEPSEGSAPGT | |
| | CGAAGGTAGCGCACCAGGTACTTCTACCGAACCGTCCGA | | STEPSEGSAPGTST | |
| | AGGCAGCGCTCCAGGTACCTCTACTGAACCTTCCGAGGG | | EPSEGSAPGTSTEP | |
| | CAGCGCTCCAGGTACCTCTACCGAACCTTCTGAAGGTAGC | | SEGSAPGSPAGSPT | |
| | GCACCAGGTACTTCTACCGAACCGTCCGAGGGTAGCGCA | | STEEGTSTEPSEGS | |
| | CCAGGTAGCCCAGCAGGTTCTCCTACCTCCACCGAGGAA | | APGTSESATPESGP | |
| | GGTACTTCTACCGAACCGTCCGAGGGTAGCGCACCAGGT | | GSEPATSGSETPGT | |
| | ACCTCTGAAAGCGCAACTCCTGAGTCTGGCCCAGGTAGC | | SESATPESGPGSEP | |
| | GAACCTGCTACCTCCGGCTCTGAGACTCCAGGTACCTCTG | | ATSGSETPGTSESA | |
| | AAAGCGCAACCCCGGAATCTGGTCCAGGTAGCGAACCTG | | TPESGPGTSTEPSE | |
| | CAACCTCTGGCTCTGAAACCCCAGGTACCTCTGAAAGCG | | GSAPGTSESATPES | |
| | CTACTCCTGAATCGGCCCAGGTACTTCTACTGAACCGTC | | GPGSPAGSPTSTEE | |
| | CGAGGGCAGCGCACCAGGTACTTCTGAAAGCGCTACTCC | | GSPAGSPTSTEEGS | |
| | TGAGTCCGGCCCAGGTAGCCCGGCTGGCTCTCCGACTTCC | | PAGSPTSTEEGTSE | |
| | ACCGAGGAAGGTAGCCCGGCTGGCTCTCCAACTTCTACT | | SATPESGPGTSTEP | |
| | GAAGAAGGTAGCCCGGCAGGCTCTCCGACCTCTACTGAG | | SEGSAPG | |
| | GAAGGTACTTCTGAAAGCGCAACCCCGGAGTCCGGCCCA | | | |
| | GGTACCTCTACCGAACCGTCTGAGGGCAGCGCACCAGGT | | | |
| | TAA | | | |

Example 22

Expression and Characterization of Binding Fusion Proteins Comprising Human Alpha-1-Anti-Trypsin (aaT) fused to XTEN_AM923 or XTEN_AM875

Cell Culture Production

A starter culture was prepared by inoculating glycerol stocks of E. coli carrying a plasmid encoding for aaT fused to AM875 or AM923 into 100 mL 2xYT media containing 40 ug/mL kanamycin. The culture was then shaken overnight at 37° C. 100 mL of the starter culture was used to inoculate 25 liters of 2xYT containing 40 mg/mL kanamycin and shaken until the OD600 reached about 1.0 (for 5 hours) at 37° C. The temperature was then reduced to 26° C. and protein expression was induced with IPTG at 1.0 mM final concentration. The culture was then shaken overnight at 26° C. Cells were harvested by centrifugation yielding a total of 200 grams cell paste. The paste was stored frozen at −80° C. until use.

Isolation of Binding Fusion Proteins Comprising aaT-XTEN_AM875 or XTEN_AM923-aaT Cell paste was suspended in 20 mM Tris pH 6.8, 50 mM NaCl at a ratio of 4 ml of buffer per gram of cell paste. Cell lysis was achieved by passing the sample once through a microfluidizer at 20000 psi. The lysate was clarified to by centrifugation at 12000 rpm in a Sorvall G3A rotor for 20 minutes. For initial activity assessment, the protein was used without further purification ("lysate").

SDS-PAGE Analysis

Figure 19:
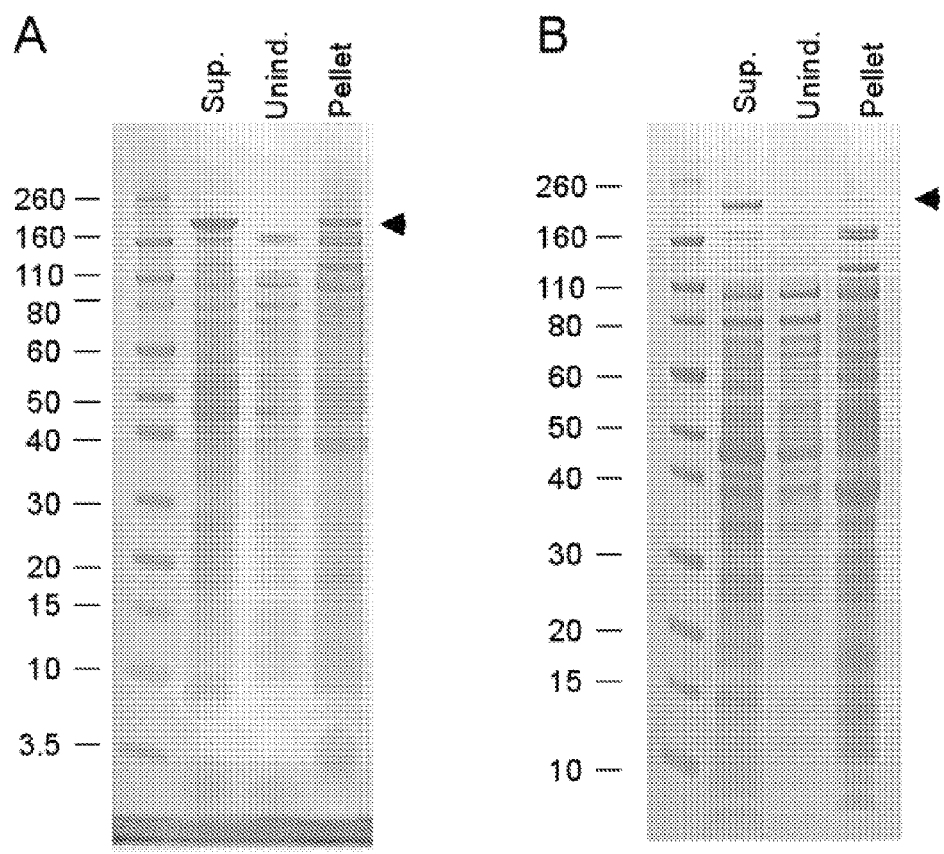
FIG. 19 shows an SDS-PAGE gel confirming expression of aaT-XTEN, as described in Example 22. The gels show lanes of molecular weight standards, induced supernatant (Sup), uninduced supernatant (Unind.), and insoluble pellet of induced cells after homogenization (Pellet) for FIG. 19A aaT-XTEN_AM875 and FIG. 19B XTEN_AM923-aaT constructs, respectively.

Approximately 10 mcg of the lysate were subjected to non-reducing SDS-PAGE using NuPAGE 4-12% Bis-Tris gel from Invitrogen according to manufacturer's specifications. The results (FIG. 19) show that the binding fusion protein constructs are expressed at high yield, with an approximate MW of about 200 kDa. The observed migration in SDS-PAGE is comparable to that observed for other binding fusion protein constructs.

Figure 20:
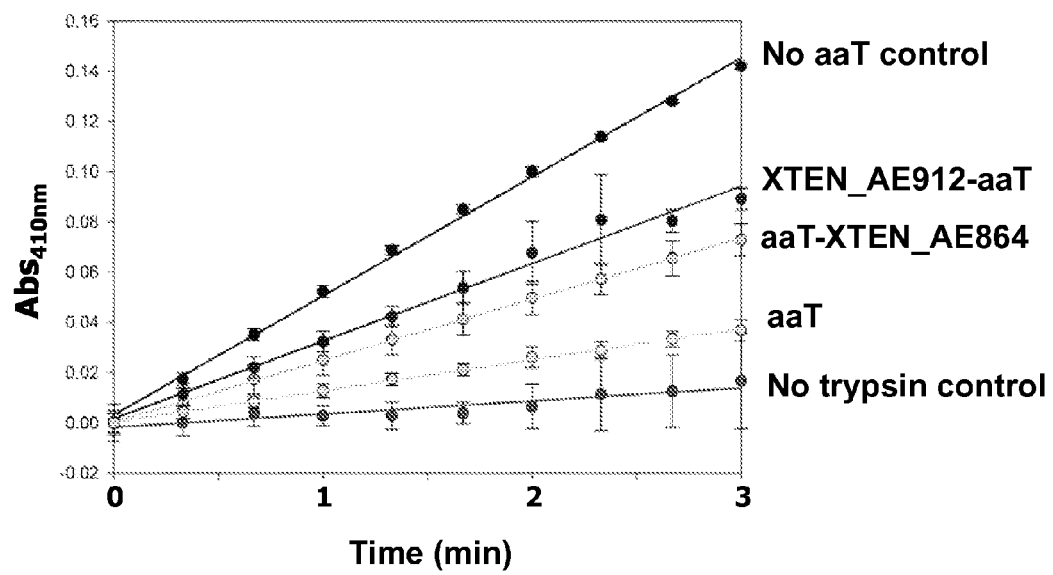
FIG. 20 shows results from a trypsin inhibition assay by aaT (control) and by two aaT-XTEN binding fusion protein constructs measuring trypsin chromogenic substrate cleavage. The assay was performed as described in Example 22, with the results shown graphically for the various groups.

Characterization of Anti-Trypsin Activity of aaT-XTEN_AM875 or XTEN_AM923-aaT-Equilibrium Analysis The pH of the lysate was adjusted to 8.0 by the addition of sodium hydroxide. To inactivate endogenous proteases phenylmethanesulfonylfluoride (PMSF, Sigma P7626) was added to a final concentration of 1 mM and the lysate was incubated on ice for 10 minutes. The lysate was then incubated at 37° C. for 4 hours to hydrolyze and inactivate the PMSF. Trypsin (Sigma T1426) was added to a concentration of 2 µM. 50 µL of lysate was dispensed per well of a 96-well microtiter plate and incubated at room temperature for 1 hour. Trypsin substrate n-benzoyl-L-arginine-p-nitroanilide (Sigma B3133) was dissolved in 20 mM Tris pH 8.0, 50 mM NaCl to 500 µM. 50 µL of substrate solution was added to the lysate and absorbance at 410 nm was read immediately at 20 second intervals for 30 minutes in a SpectraMax Plus384 spectrophotometer (Molecular Devices). Concentrations for aaT-XTEN_AM875 (XTEN attached to the C-terminus of aaT) or XTEN_AM923-aaT (XTEN attached to the N-terminus of aaT) were determined by SDS-PAGE analysis and densitometric comparison to aaT samples of known concentration. Positive control data were obtained by adding aaT purified from human plasma (Sigma, A9204) to blank lysate processed as above. The data are shown in FIG. 20 and Table 23.

TABLE 23 aaT activity

| Group | aaT (µM) | Activity units (−ΔVi/µM) | % Activity* |
|---|---|---|---|
| No aaT control | 0 | 0 | 0 |
| XTEN-aaT | 0.4 | 0.054 | 80 |
| aaT-XTEN | 0.55 | 0.057 | 84 |
| aaT positive control | 0.5 | 0.068 | 100 |
| No trypsin blank control | 1 | N/A | N/A |

*compared to aat positive control

Conclusions: The results indicate that the aaT binding fusion protein of aaT linked to XTEN retained at least 80% of the biological activity compared to aaT not linked to XTEN, indicating that the binding of the aaT to its target ligand was not substantially impaired.

Example 23

Purification and Characterization of aaT-XTEN Constructs

Purification of aaT-XTEN Constructs

The aaT-XTEN_AM875, aaT-XTEN_AE576, and aaT-XTEN_AE288 fusion proteins were purified according to the following procedure:

aaT-XTEN_AM875:

1 L of frozen whole fermenter broth containing E. coli expressing aaT-XTEN_AM875 was thawed by incubation in a 37° C. water bath. The cells were lysed by two passes at a pressure of 800 bar through an APV-2000 homogenizer. The resulting lysate was diluted with 1 L of water. 63 mL of a stock solution of 10% polyethlyleneimine (PEI, Sigma, P3143) pH 7.0 were added to 1.8 L of diluted lysate for a final PEI concentration of 0.35%. The lysate was incubated at room temperature for 30 minutes with vigorous mixing to allow for flocculate formation. The lysate was then clarified by centrifugation at 15000×g for 1 hour at 4° C. in 1 L bottles in a Fiberlite F9 rotor. The clarified lysate was filtered by depth filtration with a Cuno BioCap 25 filter (BC0025L90SP08A). The filtered lysate was loaded onto a 176.7 mL Toyopearl Super Q-650M (Tosoh, 17228) column at a flowrate of 25 mL/min. aaT-XTEN_AM875 was eluted from the column with a linear gradient from 20 mM Tris pH 6.8, 50 mM NaCl to 20 mM Tris pH 6.8, 300 mM NaCl over 70 minutes at a flowrate of 24 mL/min. aaT-XTEN_AM-875 was tracked by SDS-PAGE and product-containing fractions were pooled to a volume of 327 mL. 81.5 mL of 5 M NaCl was added to the elution pool, the sample was passed over a 36.2 mL Capto Adhere (GE, 17-5444-03) column, and the flowthrough was collected. Sample remaining on the column was chased with 72 mL of 20 mM Tris pH 7.5, 1 M NaCl and the chase sample was combined with the flowthrough for a final volume of 489 mL. 69.4 g of sodium sulfate was added to the sample to a final concentration of 1 M. aaT-XTEN_AM875 was loaded onto a 98.2 mL Toyopearl Phenyl-650M (Tosoh, 14783) column at 15 mL/min. The product was eluted with a linear gradient from 20 mM Tris pH 7.5, 1 M sodium sulfate to 20 mM Tris pH 7.5 over 70 minutes at 20 mL/min. flowrate. aaT-XTEN_AM875 was tracked by SDS-PAGE and product-containing fractions were pooled. The buffer was then exchanged to 120 mL of 20 mM Tris pH 7.5, 50 mM NaCl with a Pellicon XL 30,000 MWCO transverse flow filtration cartridge (PXBO10A50). The sample was loaded onto a 56.9 mL Capto DEAE (GE, 17-5443-03) column at a flowrate of 6 mL/min. and eluted with a linear gradient from 20 mM Tris pH 7.5, 50 mM NaCl to 20 mM Tris pH 7.5, 300 mM NaCl over 80 minutes at 8 mL/min. flowrate. aaT-XTEN_AM875 was tracked by SDS-PAGE and product-containing fractions were pooled.

aaT-XTEN_AE576

0.9 L of frozen whole fermenter broth containing E. coli expressing aaT-XTEN_AE576 was thawed by incubation in a 37° C. water bath. The cells were lysed by two passes at a pressure of 900 bar through an APV-2000 homogenizer. The resulting lysate was diluted with 0.9 L of water. 63 mL of a stock solution of 10% polyethlyleneimine (PEI, Sigma, P3143) pH 7.0 were added to 1.8 L of diluted lysate for a final PEI concentration of 0.35%. The lysate was incubated at room temperature for 1 hour with vigorous mixing to allow for flocculate formation. The lysate was then clarified by centrifugation at 15000×g for 1 hour at 4° C. in 1 L bottles in a Fiberlite F9 rotor. 300 mL of the clarified lysate was diluted with 300 mL of water. 600 mL of diluted lysate was loaded onto a 50 mL Toyopearl Super Q-650M (Tosoh, 17228) column at a flowrate of 5 mL/min. aaT-XTEN_AE576 was eluted from the column with a linear gradient from 20 mM Tris pH 6.8, 50 mM NaCl to 20 mM Tris pH 6.8, 300 mM NaCl over 72 minutes at a flowrate of 5 mL/min. aaT-XTEN_AE-576 was tracked by SDS-PAGE and product-containing fractions were pooled to a final volume of 90 mL. 22 mL of 5 M NaCl was added to the elution pool, the sample was passed over an 8 mL Capto Adhere (GE, 17-5444-03) column, and the flowthrough was collected. Sample remaining on the column was chased with 8 mL of 20 mM Tris pH 7.5, 1 M NaCl and the chase sample was combined with the flowthrough for a final volume of 117 mL. 16.6 g of sodium sulfate was added to the sample to a final concentration of 1 M. aaT-XTEN_AE576 was loaded onto a 78.5 mL Toyopearl Phenyl-650M (Tosoh, 14783) column at 7 mL/min. The product was eluted with a linear gradient from 20 mM Tris pH 7.5, 1 M sodium sulfate to 20 mM Tris pH 7.5 over 75 minutes at 15 mL/min. flowrate. aaT-XTEN_AE576 was tracked by SDS-PAGE and product-containing fractions were pooled. The buffer was then exchanged to 50 mL of 20 mM Tris pH 7.5, 50 mM NaCl with a Pellicon XL 30,000 MWCO transverse flow filtration cartridge (PXBO10A50).

aaT-XTEN_AE288

0.8 L of frozen whole fermenter broth containing E. coli expressing aaT-XTEN_AE288 was thawed by incubation in a 37° C. water bath. The cells were lysed by two passes at a pressure of 900 bar through an APV-2000 homogenizer. 150 mL of the resulting lysate was diluted with 150 mL of water. 10.5 mL of a stock solution of 10% polyethlyleneimine (PEI, Sigma, P3143) pH 7.0 were added to 300 mL of diluted lysate for a final PEI concentration of 0.35%. The lysate was incubated at room temperature for 1 hour with vigorous mixing to allow for flocculate formation. The lysate was then clarified by centrifugation at 10000 RPM in a Sorvall SL-3000 rotor for 20 minutes at 4° C. The clarified lysate was loaded onto a 53.1 mL Toyopearl Super Q-650M (Tosoh, 17228) column at a flowrate of 5 mL/min. aaT-XTEN_AE288 was eluted from the column with a linear gradient from 20 mM Tris pH 6.8, 50 mM NaCl to 20 mM Tris pH 6.8, 300 mM NaCl over 72 minutes at a flowrate of 5 mL/min. aaT-XTEN_AM-875 was tracked by SDS-PAGE and product-containing fractions were pooled to a volume of 90 mL. 22 mL of 5 M NaCl was added to the elution pool, the sample was passed over an 8 mL Capto Adhere (GE, 17-5444-03) column, and the flowthrough was collected. Sample remaining on the column was chased with 8 mL of 20 mM Tris pH 7.5, 1 M NaCl and the chase sample was combined with the flowthrough for a final volume of 117 mL. 16.6 g of sodium sulfate was added to the sample to a final concentration of 1 M. aaT-XTEN_AE288 was loaded onto a 78.5 mL Toyopearl Phenyl-650M (Tosoh, 14783) column at 7 mL/min. The product was eluted with a linear gradient from 20 mM Tris pH 7.5, 1 M sodium sulfate to 20 mM Tris pH 7.5 over 70 minutes at 15 mL/min. flowrate. aaT-XTEN_AE288 was tracked by SDS-PAGE and product-containing fractions were pooled. The buffer was then exchanged to 250 mL of 20 mM Tris pH 7.5, 50 mM NaCl with a Pellicon XL 30,000 MWCO transverse flow filtration cartridge (PXBO10A50). The sample was loaded onto a 20 mL Capto DEAE (GE, 17-5443-03) column at a flowrate of 8 mL/min. and eluted with a linear gradient from 20 mM Tris pH 7.5, 50 mM NaCl to 20 mM Tris pH 7.5, 500 mM NaCl over 40 minutes at 10 mL/min. flowrate. aaT-XTEN_AM875 was tracked by SDS-PAGE and product-containing fractions were pooled.

The final yield and analytical results for all three constructs are shown in Table 24.

TABLE 24 aaT-XTEN Purification Yields

|  | aaT-AE288 | aaT-AE576 | aaT-AM875 |
|---|---|---|---|
| Yield (mg) | 100 | 50 | 430 |
| % Yield | 33 | 31 | 24 |
| Purity (%, by SDS-PAGE) | 90 | 92 | 92 |
| Endotoxin (EU/mg) | 14 | 11 | 0.5 |
| OD260/280 | 1.0 | 0.8 | 0.7 |

SDS-PAGE Analysis of aaT-XTEN Constructs

Figure 21:
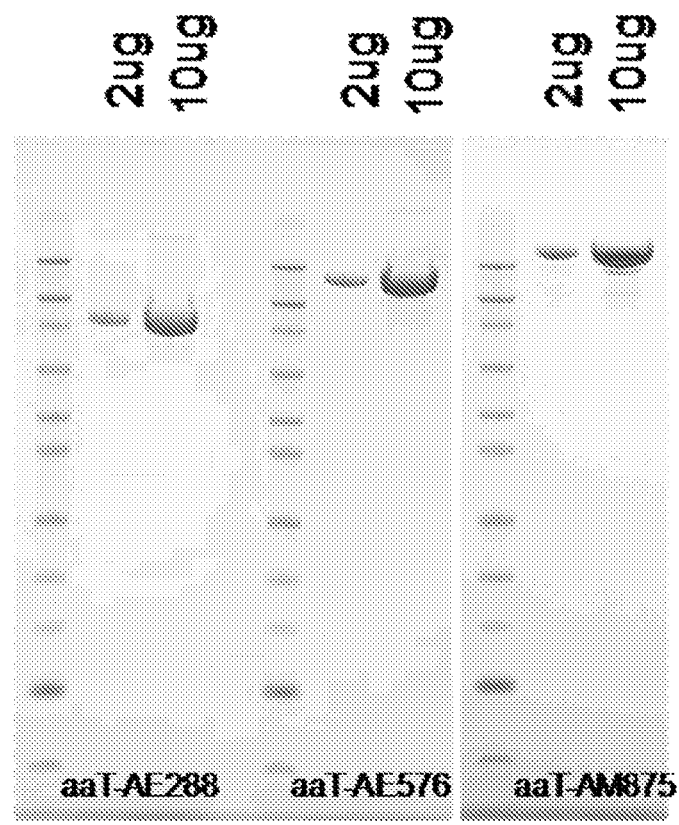
FIG. 21 shows gels from non-reducing SDS-PAGE of three aaT-XTEN constructs with differing lengths of XTEN, as described in Example 23. The results show that the aaT-XTEN constructs are highly purified, with migration rates approximately proportional to the length of the XTEN sequence attached.

Approximately 2 or 10 micrograms of the purified aaT-XTENs were subjected to non-reducing SDS-PAGE using NuPAGE 4-12% Bis-Tris gel from Invitrogen according to manufacturer's specifications. The results (FIG. 21) show that the aaT-XTEN constructs are highly purified, with migration rates approximately proportional to the length of the XTEN sequence attached. The observed migration in SDS-PAGE is comparable to that observed for other aaT-XTEN constructs of similar length.

SEC Analysis of aaT-XTEN Constructs

Figure 22:
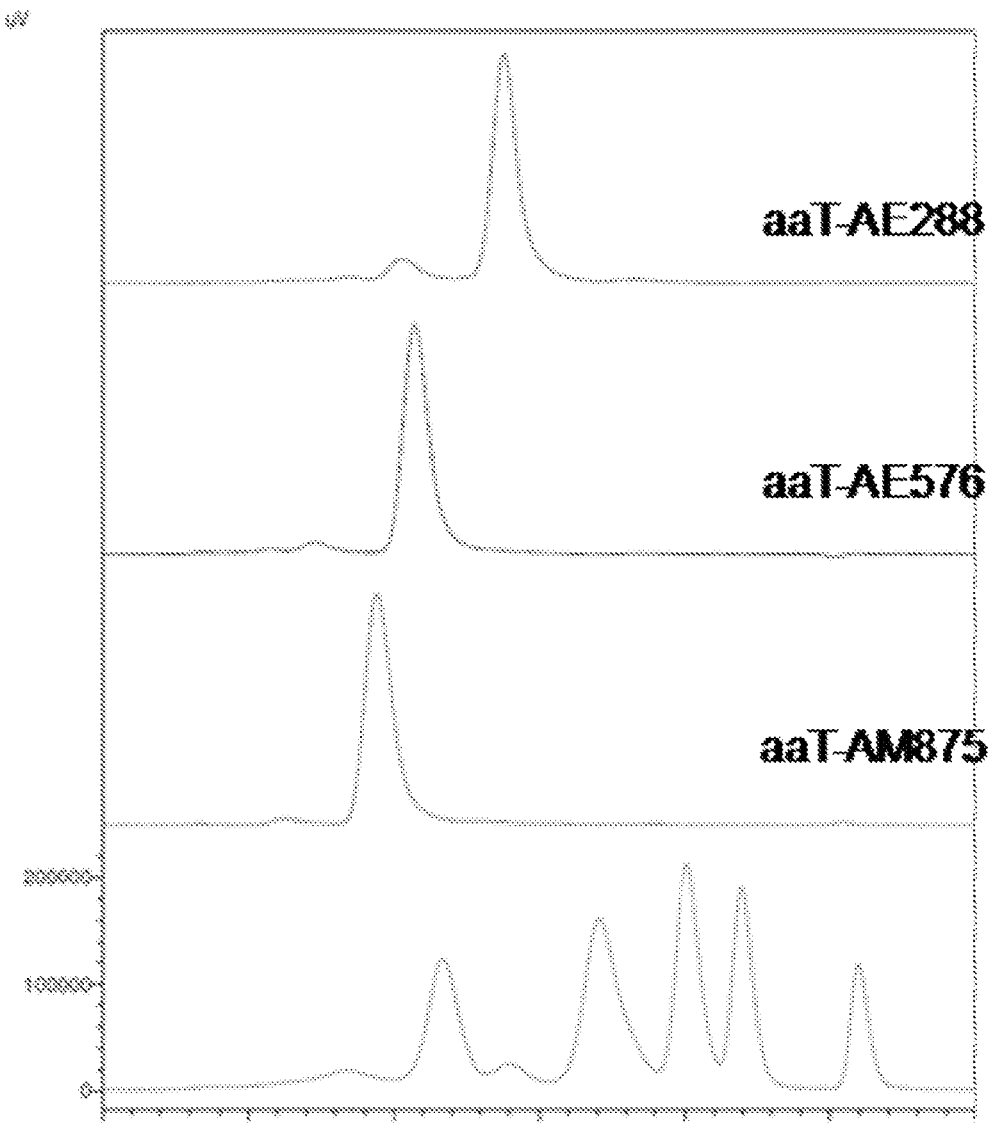
FIG. 22 shows the SEC chromatographic profiles of aaT-XTEN_AM875, aaT-XTEN_AE576, and aaT-XTEN_AE288, as described in Example 23. The data show that the apparent molecular weight of each compound is proportional to the length of the attached XTEN sequence.

Size exclusion chromatography analysis was performed using a Phenomenex BioSEP SEC S4000 (7.8 mm×60 cm) column. 20 μg of the purified protein at a concentration of 1 mg/ml was separated at a flowrate of 0.5 ml/min in 20 mM Tris pH 7.5, 300 mM NaCl. Chromatogram profiles were monitored using OD214 nm and OD280 nm Column calibration was performed using a size exclusion calibration standard from BioRad, the markers include thyroglobulin (670 kDa), bovine gamma-globulin (158 kDa), chicken ovalbumin (44 kDa), equine myoglobuin (17 kDa) and vitamin B12 (1.35 kDa). The chromatographic profiles of aaT-XTEN_AM875, aaT-XTEN_AE576, and aaT-XTEN_AE288 are shown stacked in FIG. 22. The data show that the apparent molecular weight of each compound is proportional to the length of the attached rPEG sequence. However, the data also show that the apparent molecular weight of each construct is significantly larger than that expected for a globular protein (as calculated by comparison to the standard proteins run in the same assay, data in Table 25).

TABLE 25

SEC Characterization of aaT-XTENs

|  | aaT-AE288 | aaT-AE576 | aaT-AM875 |
|---|---|---|---|
| Calculated mol. weight | 71 kDa | 97 kDa | 122 kDa |
| Apparent mol. Weight by SEC | 485 kDa | 1.9 Mda | 3.4 Mda |
| Purity (%, by SEC) | 90.5 | 92.6 | 96.0 |
| % dimer/aggregate | 9.8 | 6.8 | 2.3 |

Characterization of Anti-Trypsin Activity of aaT-XTEN_AM875 by Kinetic Analysis

Figure 23:
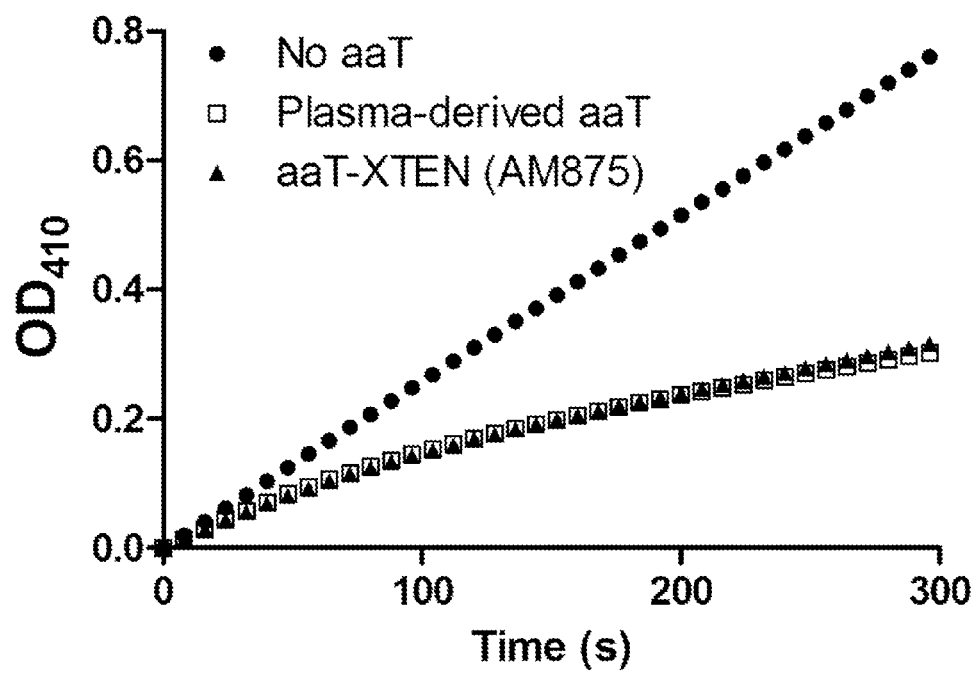
FIG. 23 shows results from a kinetic analysis of antitrypsin activity of the aaT-XTEN construct with an AM875 XTEN component compared to plasma-derived aaT, performed as described in Example 23. The results show nearly superimposable curves for rate of inhibition of trypsin.

Plasma-derived aaT (Sigma, A9204) or aaT-XTEN_AM875 was diluted to 8 μM in 20 mM Tris, 50 mM NaCl, pH 8.0. N-benzoyl-L-arginine-p-nitroanilide (Sigma, B3133) colorimetric trypsin substrate was added to the aaT solutions to a final concentration of 4 mM. In a separate tube, bovine pancreatic trypsin (Sigma, T1426) was diluted to 4 μM in 20 mM Tris, 50 mM NaCl, pH 8.0. 50 μL of the aaT+N-benzoyl-L-arginine-p-nitroanilide solution was mixed with 50 μL of the trypsin solution in duplicate wells of a certified non-binding polystyrene 96-well assay plate (Thomas Scientific, 9018). Absorbance of light at 410 nm wavelength was read immediately at 2 second intervals for 5 minutes with a Molecular Devices SpectraMax 384 spectrophotometer. Data were fit by single exponential curves with Graphpad Prism software and inhibitions constants were dived from the curves. Data are shown in FIG. 23 and Table 26.

Conclusions: aaT-XTEN_AM875 exhibits a nearly identical rate of trypsin inhibition as plasma-derived aaT.

TABLE 26

Experimental inhibition constants for plasma-derived aaT and aaT-XTEN

| aaT | $K_i$ | Max. rate of inhibition (−AU/s$^2$) |
|---|---|---|
| Plasma-derived aaT | 0.0047 | $8.76 \times 10^{-6}$ |
| aaT-XTEN_AM875 | 0.0038 | $6.59 \times 10^{-6}$ |

Figure 25:
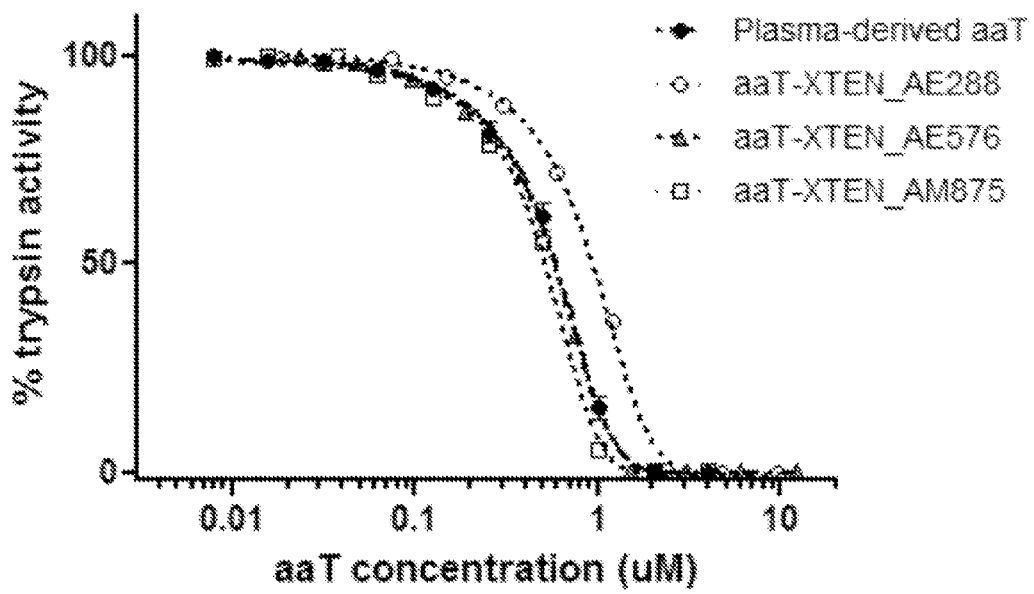
FIG. 25 shows results from a equilibrium trypsin inhibition assay of three aaT-XTEN fusion proteins and plasma-derived aaT, performed as described in Example 23.

Determination of $IC_{50}$ for aaT-XTEN Fusion Proteins and Alpha 1-Antitrypsin by Equilibrium Inhibition Assay Purified aaT-XTEN fusion proteins, including aaT-AM875, aaT-AE576, aaT-AE288, and positive control plasma-derived alpha 1-antitrypsin (Sigma A9204) were diluted to a concentration of 16 μM in 20 mM Tris pH 8.0+50 mM NaCl. The samples were then serially diluted in 2-fold increments nine times to produce a 10-point dilution series. Bovine pancreatic trypsin (Sigma T1426) was diluted to 4 μM in 20 mM Tris pH 8.0+50 mM NaCl. 50 μL of 4 μM trypsin was added to 50 μL of each aaT dilution and incubated at room temperature with shaking for 1 hour. Trypsin substrate n-benzoyl-L-arginine-p-nitroanilide (Sigma B3133) was dissolved in 20 mM Tris pH 8.0+50 mM NaCl to 1 mM. 100 μL of substrate was added to 100 μL of the sample+trypsin mixture in a microtiter plate and the absorbance at 410 nm was read immediately at 10 second intervals for 15 minutes with a SpectraMax Plus384 spectrophotometer (Molecular Devices). An initial reaction rate value was determined for each sample as the slope of a linear fit to the data over the first 180 seconds of the reaction using Microsoft Excel software. The initial reaction rate values were normalized to 100% trypsin activity by comparison with a sample lacking alpha 1-antitrypsin in the reaction. The percentage of residual trypsin activity was plotted as a function of alpha 1-antitrypsin concentration for each sample and fit with a 4-parameter sigmoidal dose response curve. $IC_{50}$ values were calculated from these curves as the concentration of alpha 1-antitrypsin inhibiting 50% of the 1 µM trypsin present in each reaction. Data are shown in FIG. 25 and Table 27.

Conclusions: The results indicate that the fusion proteins of aaT linked to XTEN of various lengths largely or completely retained biological activity compared to plasma-derived alpha 1-antitrypsin not linked to XTEN, with $IC_{50}$ values within 10% of control value for the aaT-AM875 and aaT-AE576 fusion proteins.

TABLE 27

Results of equilibrium trypsin inhibition assay

| aaT Sample | $IC_{50}$ (µM) | % Activity* |
|---|---|---|
| Plasma-derived aaT | 0.53 | 100 |
| aaT-XTEN_AM875 | 0.48 | 110 |
| aaT-XTEN_AE576 | 0.50 | 106 |
| aaT-XTEN_AE288 | 0.82 | 65 |

*Compared to positive control plasma-derived aaT

Pharmacokinetic Analysis of aaT-XTEN_AM875 or XTEN_AM923-aaT

The in vivo pharmacokinetics of binding fusion protein constructs comprising aaT can be assessed using methods equivalent to those used for other binding fusion protein constructs. Pharmacokinetics can be assessed in multiple species, however mice, rats, cynomolgus monkeys, and dogs are preferred due to their common usage in predicting human pharmacokinetics.

Figure 24:
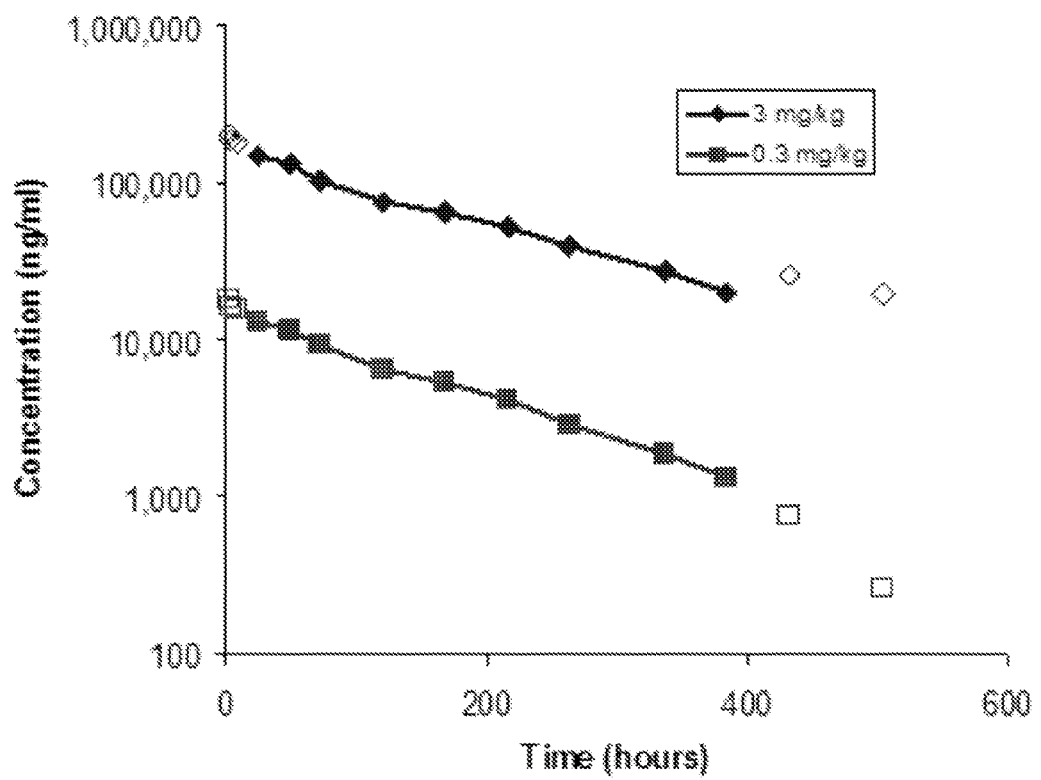
FIG. 24 shows results from a pharmacokinetic study in which aaT-XTEN_AM875 was administered intravenously to two groups of two male cynomolgus monkeys at doses of 3 mg/kg and 0.3 mg/kg, performed as described in Example 23.

To assess the pharmacokinetics of aaT-XTEN fusions, aaT-XTEN_AM875 was administered intravenously to two groups of two male cynomolgus monkeys at doses of 3 mg/kg and 0.3 mg/kg at dose volume of 0.3 mL/kg. Blood samples (1.0 mL) were collected into prechilled heparinized tubes at predose, 2, 4, 8, 24, 48, 72, 120, 168, 216, 264, 336, 388, 432, 504 hour time points, and processed into plasma. Rabbit polyclonal anti-XTEN antibodies were coated onto wells of an ELISA plate. The wells were then blocked, washed and plasma samples were then incubated in the wells at varying dilutions to allow capture of the compound by the coated antibodies. Wells were then washed extensively, and bound protein detected using a biotinylated preparation of a polyclonal anti aaT antibody and streptavidin HRP. Concentrations of test article were then calculated at each time point by comparing the colorimetric response at each serum dilution to a standard curve. A non-compartmental analysis was performed in WinNonLin with the 24 to 384 hour time points included in the fit to determine the PK parameters. The data are shown in Table 28 and FIG. 24. Using the methods described above, the construct AM923-aaT is administered to monkeys, with samples collected for analyses and determination of the PK parameters.

Conclusions: The terminal half-life of AAT-XTEN_AM875 in cynomolgus monkeys is 130 and 111 hours for doses of 3 mg/kg and 0.3 mg/kg, respectively. There is no evidence of significant dose dependence of pharmacokinetic parameters, under these conditions.

TABLE 28 aaT-AM875 Pharmacokinetics

| Dose | Cmax (ng/mL) | AUC (hr * ng/mL) | T ½ (hrs) | Volume of Distribution (mL) |
|---|---|---|---|---|
| 3 mg/kg | 200750 | 28937503 | 130 | 65.7 |
| 0.3 mg/kg | 18335 | 2292538 | 111 | 94.7 |

Example 24

Pharmacodynamic Evaluation of aaT-XTEN in Animal Models

The in vivo pharmacologic activity of aaT-XTEN constructs are assessed using preclinical models of aaT deficiency, including but not limited to mice have that overexpressed the M and Z alleles of aaT. The aaT-XTEN compositions, e.g., aaT-AM875 or AM923-aaT, are provided in an aqueous buffer compatible with in vivo administration (for example: phosphate-buffered saline or Tris-buffered saline). The compositions are administered at appropriate doses, dosing frequency, dosing schedule and route of administration as optimized for the particular model. Efficacy determinations include measurement of aaT activity and blood levels, and determination of histopathologic changes in target organs such as the lungs and liver.

In one example of a pharmacodynamic model, aaT-XTEN and plasma-derived aaT is administered to genetically-deficient mice. At various time points post-administration, levels of aaT and aaT-XTEN are measured by ELISA, activity of aaT would be measured by aaT assays. Overall, the results are used to determine those aaT-XTEN constructs more efficacious at inhibiting pulmonary or liver damage as compared to plasma-derived aaT and/or equivalent in potency to comparable dosages of aaT with less frequent or more convenient dosing intervals.

Example 25 aaT-XTEN with Cleavage Sequences

C-Terminal XTEN Releasable by FXIa

An aaT-XTEN fusion protein consisting of an XTEN protein fused to the C-terminus of aaT can be created with a XTEN release site cleavage sequence placed in between the aaT and XTEN components, as depicted in FIG. 12. Exemplary sequences are provided in Table 41. In this case, the release site cleavage sequence can be incorporated into the aaT-XTEN that contains an amino acid sequence that is recognized and cleaved by the FXIa protease (EC 3.4.21.27, Uniprot P03951). Specifically the amino acid sequence KLTRAET (SEQ ID NO: 706) is cut after the arginine of the sequence by FXIa protease. FXI is the pro-coagulant protease located immediately before FVIII in the intrinsic or contact activated coagulation pathway. Active FXIa is produced from FXI by proteolytic cleavage of the zymogen by FXIIa. Production of FXIa is tightly controlled and only occurs when coagulation is necessary for proper hemostasis. Therefore, by incorporation of the KLTRAET (SEQ ID NO: 706) cleavage sequence, the XTEN domain is removed from aaT concurrent with activation of the intrinsic coagulation pathway in proximity to the aaT-XTEN. This creates a situation where the aaT-XTEN fusion protein is processed in one additional manner during the activation of the intrinsic pathway.

C-Terminal XTEN Releasable by Elastase-2

An aaT-XTEN fusion protein consisting of an XTEN protein fused to the C-terminus of aaT can be created with a XTEN release site cleavage sequence placed in between the AAT and XTEN components, as depicted in FIG. 12. Exemplary sequences are provided in Table 41. In this case, the release site contains an amino acid sequence that is recognized and cleaved by the elastase-2 protease (EC 3.4.21.37, Uniprot P08246). Specifically the sequence LGPVSGVP (SEQ ID NO: 707) [Rawlings N. D., et al. (2008) *Nucleic Acids Res.*, 36: D320], is cut after position 4 in the sequence. Elastase is constitutively expressed by neutrophils and is present at all times in the circulation, but particularly during acute inflammation. Therefore as the long lived aaT-XTEN circulates, a fraction of it is cleaved, particularly locally during inflammatory responses, creating a pool of shorter-lived aaT to be used at the site of inflammation, when the aaT inhibitor is most needed.

C-Terminal XTEN Releasable by MMP-12

An AAT-XTEN fusion protein consisting of an XTEN protein fused to the C-terminus of AAT can be created with a XTEN release site cleavage sequence placed in between the AAT and XTEN components, as depicted in FIG. 12. Exemplary sequences are provided in Table 41. In this case, the release site contains an amino acid sequence that is recognized and cleaved by the MMP-12 protease (EC 3.4.24.65, Uniprot P39900). Specifically the sequence GPAGLGGA (SEQ ID NO: 708) [Rawlings N. D., et al. (2008) *Nucleic Acids Res.*, 36: D320], is cut after position 4 of the sequence. MMP-12 is constitutively expressed in whole blood. Therefore as the long lived AAT-XTEN circulates, a fraction of it is cleaved, creating a pool of shorter-lived AAT to be used. In a desirable feature of the inventive composition, this creates a circulating pro-drug depot that constantly releases a prophylactic amount of AAT, with higher amounts released during an inflammatory response, when the aaT inhibitor is most needed.

C-Terminal XTEN Releasable by MMP-13

An AAT-XTEN fusion protein consisting of an XTEN protein fused to the C-terminus of AAT can be created with a XTEN release site cleavage sequence placed in between the AAT and XTEN components, as depicted in FIG. 12. Exemplary sequences are provided in Table 41. In this case, the release site contains an amino acid sequence that is recognized and cleaved by the MMP-13 protease (EC 3.4.24.-, Uniprot P45452). Specifically the sequence GPAGLRGA (SEQ ID NO: 709) [Rawlings N. D., et al. (2008) *Nucleic Acids Res.*, 36: D320], is cut after position 4. MMP-13 is constitutively expressed in whole blood. Therefore as the long lived aaT-XTEN circulates, a fraction of it is cleaved, creating a pool of shorter-lived AAT to be used. In a desirable feature of the inventive composition, this creates a circulating pro-drug depot that constantly releases a prophylactic amount of aaT, with higher amounts released during an inflammatory response, when the aaT inhibitor is most needed.

C-Terminal XTEN Releasable by MMP-17

An AAT-XTEN fusion protein consisting of an XTEN protein fused to the C-terminus of AAT can be created with a XTEN release site cleavage sequence placed in between the AAT and XTEN components, as depicted in FIG. 12. Exemplary sequences are provided in Table 41. In this case, the release site contains an amino acid sequence that is recognized and cleaved by the MMP-20 protease (EC.3.4.24.-, Uniprot Q9ULZ9). Specifically the sequence APLGLRLR (SEQ ID NO: 710) [Rawlings N. D., et al. (2008) *Nucleic Acids Res.*, 36: D320], is cut after position 4 in the sequence. MMP-17 is constitutively expressed in whole blood. Therefore as the long lived aaT-XTEN circulates, a fraction of it is cleaved, creating a pool of shorter-lived aaT to be used. In a desirable feature of the inventive composition, this creates a circulating pro-drug depot that constantly releases a prophylactic amount of aaT, with higher amounts released during an inflammatory response, when the aaT inhibitor is most needed.

C-Terminal XTEN Releasable by MMP-20

An aaT-XTEN fusion protein consisting of an XTEN protein fused to the C-terminus of aaT can be created with a XTEN release site cleavage sequence placed in between the aaT and XTEN components, as depicted in FIG. 12. Exemplary sequences are provided in Table 41. In this case, the release site contains an amino acid sequence that is recognized and cleaved by the MMP-20 protease (EC.3.4.24.-, Uniprot O60882). Specifically the sequence PALPLVAQ (SEQ ID NO: 711) [Rawlings N. D., et al. (2008) *Nucleic Acids Res.*, 36: D320], is cut after position 4 (depicted by the arrow). MMP-20 is constitutively expressed in whole blood. Therefore as the long lived aaT-XTEN circulates, a fraction of it is cleaved, creating a pool of shorter-lived aaT to be used. In a desirable feature of the inventive composition, this creates a circulating pro-drug depot that constantly releases a prophylactic amount of aaT, with higher amounts released during an inflammatory response, when the aaT inhibitor is most needed.

Optimization of the Release Rate of C-Terminal XTEN

Variants of the foregoing constructs of the Examples can be created in which the release rate of C-terminal XTEN is altered. As the rate of XTEN release by an XTEN release protease is dependent on the sequence of the XTEN release site, by varying the amino acid sequence in the XTEN release site one can control the rate of XTEN release. The sequence specificity of many proteases is well known in the art, and is documented in several data bases. In this case, the amino acid specificity of proteases is mapped using combinatorial libraries of substrates [Harris, J. L., et al. (2000) *Proc Natl Acad Sci USA*, 97: 7754] or by following the cleavage of substrate mixtures as illustrated in [Schellenberger, V., et al. (1993) *Biochemistry*, 32: 4344]. An alternative is the identification of optimal protease cleavage sequences by phage display [Matthews, D., et al. (1993) *Science*, 260: 1113]. Constructs is made with variant sequences and assayed for XTEN release using standard assays for detection of the XTEN polypeptides.

Example 26

Human Clinical Trial Designs for Evaluating aaT-XTEN Comprising aaT

Prolastin®C is a plasma-derived from of alpha-1-antitrypsin (a.k.a. alpha 1-antiproteinase) that, in treatment of congenital aaT deficiency, must be dosed at 60 mg/kg once per week; a requirement of more than 200 grams of protein/patient/year. As demonstrated in Example 23, fusion of XTEN to aaT results in improved half-life compared to that known for the non-glycosylated form of the aaT protein, enabling a reduced dosing frequency using such aaT-XTEN-containing fusion protein compositions such that clinical trials in humans comparing an aaT-XTEN fusion protein to plasma-derived aaT formulations could be performed, such that the efficacy and advantages of the aaT-XTEN binding fusion protein compositions can be verified in humans.

Such studies would comprise three phases. First, a Phase I safety and pharmacokinetics study in adult patients is conducted to determine the maximum tolerated dose and pharmacokinetics and pharmacodynamics in humans (either normal subjects or patients with genetic deficiency of aaT), as well as to define potential toxicities and adverse events to be tracked in future studies. A Phase I study is conducted in which single rising doses of an aaT-XTEN composition, such as are disclosed herein, are administered by the desired route (e.g., subcutaneous, intramuscular, intravenously, or by the pulmonary route) and biochemical, PK, and clinical parameters are measured at defined intervals. This would permit the determination of the minimum effective dose and the maximum tolerated dose and establishes the threshold and maximum concentrations in dosage and circulating drug that constitute the therapeutic window for the respective components. From this information, the dose and dose schedule that permits less frequent administration of the aaT-XTEN compositions, yet retains the pharmacologic response, is obtained. Thereafter, Phase II and III clinical trials are conducted in patients with the aaT-deficient condition, verifying the effectiveness of the aaT-XTEN compositions under the dose conditions. Clinical trials could be conducted in patients suffering from any disease in which native aaT may be expected to provide clinical benefit. For example, such indications include emphysema; chronic obstructive pulmonary disease (COPD); bronchiectasis; parenchymatic and fibrotic lung diseases or disorders; cystic fibrosis, interstitial pulmonary fibrosis and sarcoidosis; liver cirrhosis or liver failure; and tuberculosis and lung diseases and disorders secondary to HIV. Trials monitor patients before, during and after treatment for changes in physiologic and clinical parameters associated with the respective indications; e.g., lung function tests to measure total lung capacity, forced vital capacity (FVC), or forced expiratory volume (FEV) for COPD or emphysema, as well as clinical endpoints such as organ failure and/or survival; parameters that are tracked relative to the placebo or positive control groups. Efficacy outcomes are determined using standard statistical methods. Toxicity and adverse event markers are also followed in the study to verify that the compound is safe when used in the manner described.

Example 27

Biodistribution of Large XTEN Molecules

It is likely that aaT-XTEN's primary site of action in vivo is in the lungs. Therefore, it is important to confirm that addition of the XTEN fusion does not impede the diffusion of the aaT-XTEN construct into the lung tissue. To verify that constructs with long XTEN fusions can penetrate into lung tissue, the biodistribution of three fluorescently tagged constructs was tested in mice, aHer2-XTEN-864-Alexa 680, aHer2-XTEN-576-Alexa 680, and aHer2-XTEN-288-Alexa 680, using fluorescence imaging. The aHer2 payload is a scFv fragment specific for binding the Her2 antigen, which is not found on normal tissues (and hence should not affect biodistribution in normal animals). This study also included fluorescently tagged Herceptin-Alexa 680 as a control antibody.

The mice were given a single intravenous injection of each agent. After 72 hours, all groups were euthanized and liver, lung, heart, spleen and kidneys were ex vivo imaged using fluorescence imaging. The data are shown Table 29.

Conclusions: All constructs showed significant penetration into all tissues assayed. The lower overall fluorescence signals of the XTEN_576 and XTEN_288 groups are attributed to the increased clearance of the shorter XTEN constructs over the 72 hour distribution period. Similar proportions for lung fluorescence relative to total signal were observed for all groups, including the antibody control, supporting that XTEN fusion protein constructs are bioavailable in lung tissue under these conditions.

TABLE 29

Fluorescence Signals by Ortan

| Test Material | Dose (nmol/ mouse) | Total Fluorescence Efficiency (group mean) (×1e−6) | | | | |
|---|---|---|---|---|---|---|
| | | Heart | Lungs | Spleen | Liver | Kidney |
| scFv-XTEN-864-Alexa 680 | 6.7 | 28 | 130 | 16 | 180 | 120 |
| scFv-XTEN-576-Alexa 680 | 6.7 | 6.8 | 24 | 3.4 | 48 | 31 |
| scFv-XTEN-288-Alexa 680 | 6.7 | 1.9 | 5.6 | 2.1 | 20 | 34 |
| mAb-Alexa680 Control | 3.3 | 32 | 150 | 25 | 370 | 110 |

Example 28

Figure 18:
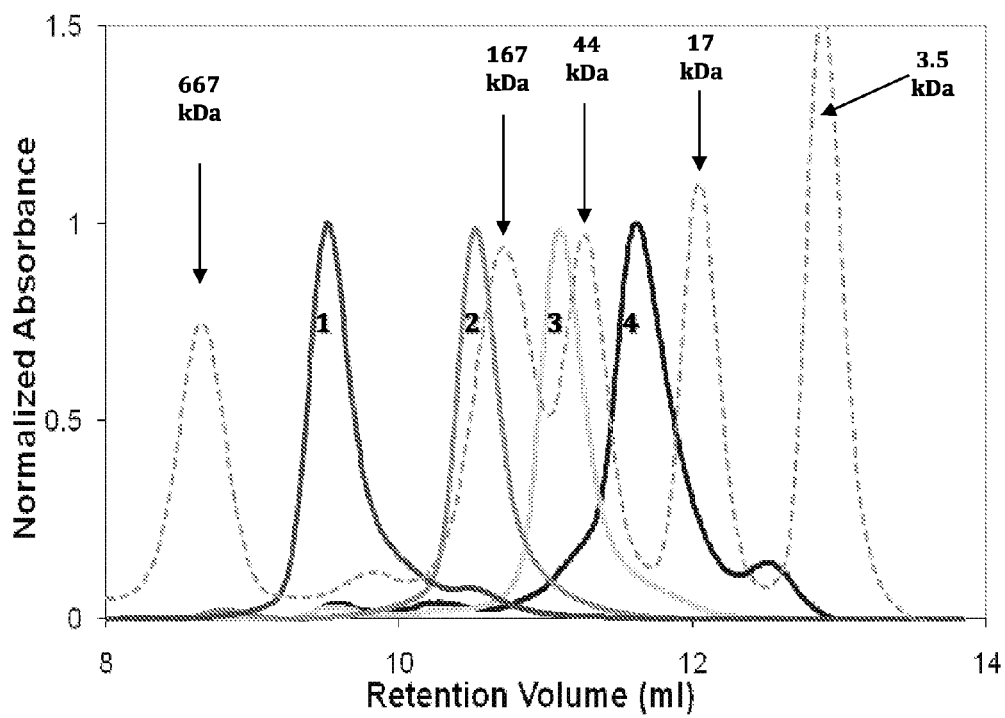
FIG. 18 shows results of a size exclusion chromatography analysis of glucagon-XTEN construct samples measured against protein standards of known molecular weight, with the graph output as absorbance versus retention volume, as described in Example 28. The glucagon-XTEN constructs are 1) glucagon-Y288; 2) glucagonY-144; 3) glucagon-Y72; and 4) glucagon-Y36. The results indicate an increase in apparent molecular weight with increasing length of XTEN moiety.

Analytical Size Exclusion Chromatography of XTEN Fusion Proteins with Diverse Payloads Size exclusion chromatography analyses were performed on fusion proteins containing various therapeutic proteins and unstructured recombinant proteins of increasing length. An exemplary assay used a TSKGel-G4000 SWXL (7.8 mm×30 cm) column in which 40 µg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm Column calibration for all assays were performed using a size exclusion calibration standard from BioRad; the markers include thyroglobulin (670 kDa), bovine gamma-globulin (158 kDa), chicken ovalbumin (44 kDa), equine myoglobin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 18. The data show that the apparent molecular weight of each compound is proportional to the length of the attached XTEN sequence. However, the data also show that the apparent molecular weight of each construct is significantly larger than that expected for a globular protein (as shown by comparison to the standard proteins run in the same assay). Based on the SEC analyses for all constructs evaluated, including an aaT-XTEN composition, the apparent molecular weights, the apparent molecular weight factor (expressed as the ratio of apparent molecular weight to the calculated molecular weight) and the hydrodynamic radius ($R_H$ in nm) are shown in Table 30. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater; well beyond the glomerular pore size of approximately 3-5 nm. Accordingly, it is expected that fusion proteins comprising growth and XTEN have reduced renal clearance, contributing to increased terminal half-life and improving the therapeutic or biologic effect relative to a corresponding un-fused biologic payload protein.

TABLE 30

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC398 | AE288 | FVII | 76.3 | 650 | 8.5 | 8.2 |
| AC404 | AE864 | FVII | 129 | 1900 | 14.7 | 10.1 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | hGH | 100.6 | 846 | 8.4 | 8.7 |
| AC227 | AM875 | IL-1ra | 95.4 | 1103 | 11.6 | 9.2 |
| AC228 | AM1318 | IL-1ra | 134.8 | 2286 | 17.0 | 10.5 |

Example 29

Pharmacokinetics of Extended Polypeptides Fused to GFP in Cynomolgus Monkeys

Figure 16:
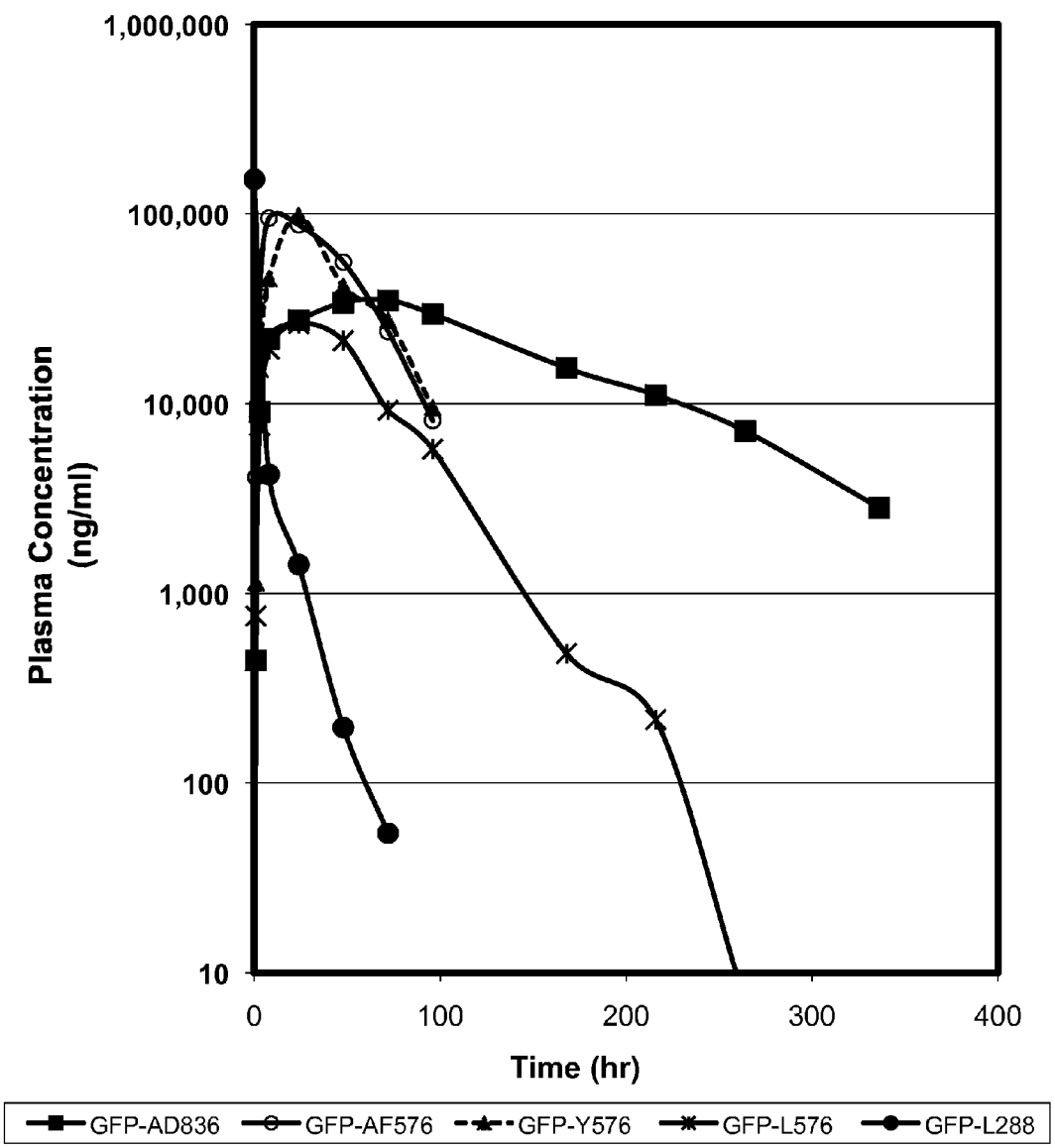
FIG. 16 shows the pharmacokinetic profile (plasma concentrations) in cynomolgus monkeys after single doses of different compositions of GFP linked to unstructured polypeptides of varying length, administered either subcutaneously or intravenously, as described in Example 29. The compositions were GFP-L288, GFP-L576, GFP-XTEN_AF576, GFP-Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 16. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 30

Serum Stability of XTEN

Figure 17:
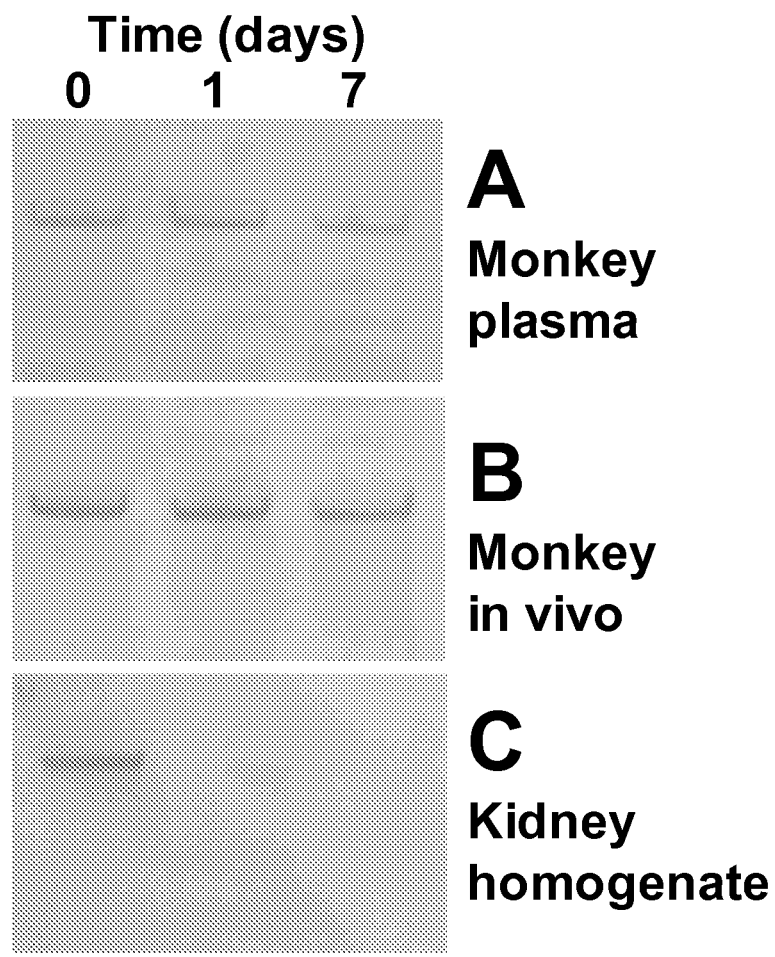
FIG. 17 shows an SDS-PAGE gel of samples from a stability study of the fusion protein of XTEN_AE864 fused to the N-terminus of GFP (see Example 30). The GFP-XTEN was incubated in cynomolgus plasma and rat kidney lysate for up to 7 days at 37° C. In addition, GFP-XTEN administered to cynomolgus monkeys was also assessed. Samples were withdrawn at 0, 1 and 7 days and analyzed by SDS PAGE followed by detection using Western analysis with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 17. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of aaT-XTEN to degradation due to serum proteases; a factor in the enhancement of pharmacokinetic properties of the aaT-XTEN fusion proteins.

Example 31

Increasing Solubility and Stability of a Peptide Payload by Linking to XTEN

In order to evaluate the ability of XTEN to enhance the physicochemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 31. For comparative purposes, the solubility limit of unmodified glucagon in the same buffer was measured at 60 µM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144xTEN, the limit of solubility was determined, with the result that a 60-fold increase in solubility was achieved, compared to glucagon not linked to XTEN. In addition, the glucagon-AF144 aaT-XTEN was evaluated for stability, and was found to be stable in liquid formulation for at least 6 months under refrigerated conditions and for approximately one month at 37° C. (data not shown).

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 31

Solubility of Glucagon-XTEN constructs

| Test Article | Solubility |
|---|---|
| Glucagon | 60 µM |
| Glucagon-Y36 | >370 µM |
| Glucagon-Y72 | >293 µM |

TABLE 31-continued

Solubility of Glucagon-XTEN constructs

| Test Article | Solubility |
|---|---|
| Glucagon-AF108 | >145 μM |
| Glucagon-AF120 | >160 μM |
| Glucagon-Y144 | >497 μM |
| Glucagon-AE144 | >467 μM |
| Glucagon-AF144 | >3600 μM |
| Glucagon-Y288 | >163 μM |

Example 32

Analysis of Sequences for Secondary Structure by Prediction Algorithms

Amino acid sequences can be assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbilibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequences in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 32.

The results indicate that, by the Chou-Fasman calculations, short XTEN of the AE and AG families, up to at least 288 amino acid residues, have no alpha-helices or beta sheets, but amounts of predicted percentage of random coil by the GOR algorithm vary from 78-99%. With increasing XTEN lengths of 504 residues to greater than 1300, the XTEN analyzed by the Chou-Fasman algorithm had predicted percentages of alpha-helices or beta sheets of 0 to about 2%, while the calculated percentages of random coil increased to from 94-99%. Those XTEN with alpha-helices or beta sheets were those sequences with one or more instances of three contiguous serine residues, which resulted in predicted beta-sheet formation. However, even these sequences still had approximately 99% random coil formation.

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. Based on the numerous sequences evaluated by these methods, it is concluded that XTEN created from sequence motifs of G, S, T, E, P, and A that have limited repetitiveness (defined as no more than two identical contiguous amino acids in any one motif) are expected to have very limited secondary structure. With the exception of motifs containing three contiguous serines, it is believed that any order or combination of sequence motifs from Table 3 can be used to create an XTEN polypeptide that will result in an XTEN sequence that is substantially devoid of secondary structure, and that the effects of three contiguous serines is ameliorated by increasing the length of the XTEN. Such sequences are expected to have the characteristics described in the aaT-XTEN embodiments of the invention disclosed herein.

TABLE 32

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AE36: LCW0402_002 | GSPAGSPTSTEEGTSESATPESGPGT STEPSEGSAP | 712 | 36 | Residue totals: H: 0 E: 0 percent: H: 0.0 E: 0.0 | 94.44% |
| AE36: LCW0402_003 | GTSTEPSEGSAPGTSTEPSEGSAPGT STEPSEGSAP | 713 | 36 | Residue totals: H: 0 E: 0 percent: H: 0.0 E: 0.0 | 94.44% |
| AG36: LCW0404_001 | GASPGTSSTGSPGTPGSGTASSSPGS STPSGATGSP | 714 | 36 | Residue totals: H: 0 E: 0 percent: H: 0.0 E: 0.0 | 77.78% |
| AG36: LCW0404_003 | GSSTPSGATGSPGSSPSASTGTGPGS STPSGATGSP | 715 | 36 | Residue totals: H: 0 E: 0 percent: H: 0.0 E: 0.0 | 83.33% |

TABLE 32-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AE42_1 | TEPSEGSAPGSPAGSPTSTEEGTSES ATPESGPGSEPATSGS | 716 | 42 | Residue totals: H: 0 E: 0 percent: H: 0.0 E: 0.0 | 90.48% |
| AE42_1 | TEPSEGSAPGSPAGSPTSTEEGTSES ATPESGPGSEPATSGS | 717 | 42 | Residue totals: H: 0 E: 0 percent: H: 0.0 E: 0.0 | 90.48% |
| AG42_1 | GAPSPSASTGTGPGTPGSGTASSSPG SSTPSGATGSPGPSGP | 718 | 42 | Residue totals: H: 0 E: 0 percent: H: 0.0 E: 0.0 | 88.10% |
| AG42_2 | GPGTPGSGTASSSPGSSTPSGATGSP GSSPSASTGTGPGASP | 719 | 42 | Residue totals: H: 0 E: 0 percent: H: 0.0 E: 0.0 | 88.10% |
| AE144 | GSEPATSGSETPGTSESATPESGPGS EPATSGSETPGSPAGSPTSTEEGTST EPSEGSAPGSEPATSGSETPGSEPAT SGSETPGSEPATSGSETPGTSTEPSE GSAPGTSESATPESGPGSEPATSGSE TPGTSTEPSEGSAP | 720 | 144 | Residue totals: H: 0 E: 0 percent: H: 0.0 E: 0.0 | 98.61% |
| AG144_1 | PGSSPSASTGTGPGSSPSASTGTGPG TPGSGTASSSPGSSTPSGATGSPGSS PSASTGTGPGASPGTSSTGSPGTPGS GTASSSPGSSTPSGATGSPGTPGSGT ASSSPGASPGTSSTGSPGASPGTSST GSPGTPGSGTASSS | 721 | 144 | Residue totals: H: 0 E: 0 percent: H: 0.0 E: 0.0 | 91.67% |
| AE288 | GTSESATPESGPGSEPATSGSETPGT SESATPESGPGSEPATSGSETPGTSE SATPESGPGTSTEPSEGSAPGSPAGS PTSTEEGTSESATPESGPGSEPATSG SETPGTSESATPESGPGSPAGSPTST EEGSPAGSPTSTEEGTSTEPSEGSAP GTSESATPESGPGTSESATPESGPGT SESATPESGPGSEPATSGSETPGSEP ATSGSETPGSPAGSPTSTEEGTSTEP SEGSAPGTSTEPSEGSAPGSEPATSG SETPGTSESATPESGPGTSTEPSEGS AP | 722 | 288 | Residue totals: H: 0 E: 0 percent: H: 0.0 E: 0.0 | 99.31% |
| AG288_2 | GSSPSASTGTGPGSSPSASTGTGPGT PGSGTASSSPGSSTPSGATGSPGSSP SASTGTGPGASPGTSSTGSPGTPGSG TASSSPGSSTPSGATGSPGTPGSGTA SSSPGASPGTSSTGSPGASPGTSSTG SPGTPGSGTASSSPGSSTPSGATGSP GASPGTSSTGSPGTPGSGTASSSPGS STPSGATGSPGSSPSASTGTGPGSSP SASTGTGPGSSTPSGATGSPGSSTPS GATGSPGASPGTSSTGSPGASPGTSS TGSPGASPGTSSTGSPGTPGSGTASS SP | 723 | 288 | Residue totals: H: 0 E: 0 percent: H: 0.0 E: 0.0 | 92.71 |
| AF504 | GASPGTSSTGSPGSSPSASTGTGPGS SPSASTGTGPGTPGSGTASSSPGSST PSGATGSPGSNPSASTGTGPGASPG TSSTGSPGTPGSGTASSSPGSSTPSG ATGSPGTPGSGTASSSPGASPGTSST GSPGASPGTSSTGSPGTPGSGTASSS PGSSTPSGATGSPGASPGTSSTGSPG TPGSGTASSSPGSSTPSGATGSPGSN PSASTGTGPGSSPSASTGTGPGSSTP SGATGSPGSSTPSGATGSPGASPGTS STGSPGASPGTSSTGSPGASPGTSST GSPGTPGSGTASSSPGASPGTSSTGS PGASPGTSSTGSPGASPGTSSTGSPG SSPSASTGTGPGTPGSGTASSSPGAS PGTSSTGSPGASPGTSSTGSPGASPG TSSTGSPGSSTPSGATGSPGSSTPSG ATGSPGASPGTSSTGSPGTPGSGTAS SSPGSSTPSGATGSPGSSTPSGATGS PGSSTPSGATGSPGSSPSASTGTGPG ASPGTSSTGSP | 724 | 504 | Residue totals: H: 0 E: 0 percent: H: 0.0 E: 0.0 | 94.44% |

TABLE 32-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AD 576 | GSSESGSSEGGPGSGGEPSESGSSGS SESGSSEGGPGSSESGSSEGGPGSSE SGSSEGGPGSSESGSSEGGPGSSESG SSEGGPGESPGGSSGSESGSEGSSGP GESSGSSESGSSEGGPGSSESGSSEG GPGSSESGSSEGGPGSGGEPSESGSS GESPGGSSGSESGESPGGSSGSESGS GGEPSESGSSGSSESGSSEGGPGSGG EPSESGSSGSGGEPSESGSSGSEGSS GPGESSGESPGGSSGSESGSGGEPSE SGSSGSGGEPSESGSSGSGGEPSESG SSGSSESGSSEGGPGESPGGSSGSES GESPGGSSGSESGESPGGSSGSESGE SPGGSSGSESGESPGGSSGSESGSSE SGSSEGGPGSGGEPSESGSSGSEGSS GPGESSGSSESGSSEGGPGSGGEPSE SGSSGSSESGSSEGGPGSGGEPSESG SSGESPGGSSGSESGESPGGSSGSES GSSESGSSEGGPGSGGEPSESGSSGS SESGSSEGGPGSGGEPSESGSSGSGG EPSESGSSGESPGGSSGSESGSEGSS GPGESSGSSESGSSEGGPGSEGSSGP GESS | 725 | 576 | Residue totals: H: 7 E: 0 percent: H: 1.2 E: 0.0 | 99.65% |
| AE576 | GSPAGSPTSTEEGTSESATPESGPGT STEPSEGSAPGSPAGSPTSTEEGTST EPSEGSAPGTSTEPSEGSAPGTSESA TPESGPGSEPATSGSETPGSEPATSG SETPGSPAGSPTSTEEGTSESATPES GPGTSTEPSEGSAPGTSTEPSEGSAP GSPAGSPTSTEEGTSTEPSEGSAPGT STEPSEGSAPGTSESATPESGPGTST EPSEGSAPGTSESATPESGPGSEPAT SGSETPGTSTEPSEGSAPGTSTEPSE GSAPGTSESATPESGPGTSESATPES GPGSPAGSPTSTEEGTSESATPESGP GSEPATSGSETPGTSESATPESGPGT STEPSEGSAPGTSTEPSEGSAPGTST EPSEGSAPGTSTEPSEGSAPGTSTEP SEGSAPGTSTEPSEGSAPGSPAGSPT STEEGTSTEPSEGSAPGTSESATPES GPGSEPATSGSETPGTSESATPESGP GSEPATSGSETPGTSESATPESGPGT STEPSEGSAPGTSESATPESGPGSPA GSPTSTEEGSPAGSPTSTEEGSPAGS PTSTEEGTSESATPESGPGTSTEPSE GSAP | 726 | 576 | Residue totals: H: 2 E: 0 percent: H: 0.4 E: 0.0 | 99.65% |
| AG576 | PGTPGSGTASSSPGSSTPSGATGSPG SSPSASTGTGPGSSPSASTGTGPGSS TPSGATGSPGSSTPSGATGSPGASPG TSSTGSPGASPGTSSTGSPGASPGTS STGSPGTPGSGTASSSPGASPGTSST GSPGASPGTSSTGSPGASPGTSSTGS PGSSPSASTGTGPGTPGSGTASSSPG ASPGTSSTGSPGASPGTSSTGSPGAS PGTSSTGSPGSSTPSGATGSPGSSTPS GATGSPGASPGTSSTGSPGTPGSGT ASSSPGSSTPSGATGSPGSSTPSGAT GSPGSSTPSGATGSPGSSPSASTGTG PGASPGTSSTGSPGASPGTSSTGSPG TPGSGTASSSPGASPGTSSTGSPGAS PGTSSTGSPGASPGTSSTGSPGASPG TSSTGSPGTPGSGTASSSPGSSTPSG ATGSPGTPGSGTASSSPGSSTPSGAT GSPGTPGSGTASSSPGSSTPSGATGS PGSSTPSGATGSPGSSPSASTGTGPG SSPSASTGTGPGASPGTSSTGSPGTP GSGTASSSPGSSTPSGATGSPGSSPS ASTGTGPGSSPSASTGTGPGASPGTS STGS | 727 | 576 | Residue totals: H: 0 E: 3 percent: H: 0.4 E: 0.5 | 99.31% |

TABLE 32-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AF540 | GSTSSTAESPGPGSTSSTAESPGPGS TSESPSGTAPGSTSSTAESPGPGSTSS TAESPGPGTSTPESGSASPGSTSESPS GTAPGTSPSGESSTAPGSTSESPSGT APGSTSESPSGTAPGTSPSGESSTAP GSTSESPSGTAPGSTSESPSGTAPGT SPSGESSTAPGSTSESPSGTAPGSTSE SPSGTAPGSTSESPSGTAPGTSTPES GSASPGSTSESPSGTAPGTSTPESGS ASPGSTSSTAESPGPGSTSSTAESPG PGTSTPESGSASPGTSTPESGSASPG STSESPSGTAPGTSTPESGSASPGTST PESGSASPGSTSESPSGTAPGSTSESP SGTAPGSTSESPSGTAPGSTSSTAES PGPGTSTPESGSASPGTSTPESGSAS PGSTSESPSGTAPGSTSESPSGTAPG TSTPESGSASPGSTSESPSGTAPGSTS ESPSGTAPGTSTPESGSASPGTSPSG ESSTAPGSTSSTAESPGPGTSPSGESS TAPGSTSSTAESPGPGTSTPESGSAS PGSTSESPSGTAP | 728 | 540 | Residue totals: H: 2 E: 0 percent: H: 0.4 E: 0.0 | 99.65 |
| AD836 | GSSESGSSEGGPGSSESGSSEGGPGE SPGGSSGSESGSGGEPSESGSSGESP GGSSGSESGESPGGSSGSESGSSESG SSEGGPGSSESGSSEGGPGSSESGSS EGGPGESPGGSSGSESGESPGGSSGS ESGESPGGSSGSESGSSESGSSEGGP GSSESGSSEGGPGSSESGSSEGGPGS SESGSSEGGPGSSESGSSEGGPGSSE SGSSEGGPGSGGEPSESGSSGESPGG SSGSESGESPGGSSGSESGSGGEPSE SGSSGSEGSSGPGESSGSSESGSSEG GPGSGGEPSESGSSGSEGSSGPGESS GSSESGSSEGGPGSGGEPSESGSSGE SPGGSSGSESGSGGEPSESGSSGSGG EPSESGSSGSSESGSSEGGPGSGGEP SESGSSGSGGEPSESGSSGSEGSSGP GESSGESPGGSSGSESGSEGSSGPGE SSGSEGSSGPGESSGSGGGEPSESGSS GSSESGSSEGGPGSSESGSSEGGPGE SPGGSSGSESGSGGEPSESGSSGSEG SSGPGESSGESPGGSSGSESGSEGSS GPGSSESGSSEGGPGSGGEPSESGSS GSEGSSGPGESSGSEGSSGPGESSGS EGSSGPGESSGSGGEPSESGSSGSGG EPSESGSSGESPGGSSGSESGESPGG SSGSESGGGEPSESGSSGSEGSSGP GESSGESPGGSSGSESGSSESGSSEG GPGSSESGSSEGGPGSSESGSSEGGP GSGGEPSESGSSGSSESGSSEGGPGE SPGGSSGSESGSGGEPSESGSSGSSE SGSSEGGPGESPGGSSGSESGSGGEP SESGSSGESPGGSSGSESGSGGEPSE SGSS | 729 | 836 | Residue totals: H: 0 E: 0 percent: H: 0.0 E: 0.0 | 98.44% |
| AE864 | GSPAGSPTSTEEGTSESATPESGPGT STEPSEGSAPGSPAGSPTSTEEGTST EPSEGSAPGTSTEPSEGSAPGTSESA TPESGPGSEPATSGSETPGSEPATSG SETPGSPAGSPTSTEEGTSESATPES GPGTSTEPSEGSAPGTSTEPSEGSAP GSPAGSPTSTEEGTSTEPSEGSAPGT STEPSEGSAPGTSESATPESGPGTST EPSEGSAPGTSESATPESGPGSEPAT SGSETPGTSTEPSEGSAPGTSTEPSE GSAPGTSESATPESGPGTSESATPES GPGSPAGSPTSTEEGTSESATPESGP GSEPATSGSETPGTSESATPESGPGT STEPSEGSAPGTSTEPSEGSAPGTST EPSEGSAPGTSTEPSEGSAPGTSTEP SEGSAPGTSTEPSEGSAPGSPAGSPT STEEGTSTEPSEGSAPGTSESATPES GPGSEPATSGSETPGTSESATPESGP GSEPATSGSETPGTSESATPESGPGT | 730 | 864 | Residue totals: H: 2 E: 3 percent: H: 0.2 E: 0.4 | 99.77% |

TABLE 32-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | STEPSEGSAPGTSESATPESGPGSPA GSPTSTEEGSPAGSPTSTEEGSPAGS PTSTEEGTSESATPESGPGTSTEPSE GSAPGTSESATPESGPGSEPATSGSE TPGTSESATPESGPGSEPATSGSETP GTSESATPESGPGTSTEPSEGSAPGS PAGSPTSTEEGTSESATPESGPGSEP ATSGSETPGTSESATPESGPGSPAGS PTSTEEGSPAGSPTSTEEGTSTEPSE GSAPGTSESATPESGPGTSESATPES GPGTSESATPESGPGSEPATSGSETP GSEPATSGSETPGSPAGSPTSTEEGT STEPSEGSAPGTSTEPSEGSAPGSEP ATSGSETPGTSESATPESGPGTSTEP SEGSAP | | | | |
| AF864 | GSTSESPSGTAPGTSPSGESSTAPGS TSESPSGTAPGSTSESPSGTAPGTSTP ESGSASPGTSTPESGSASPGSTSESPS GTAPGSTSESPSGTAPGTSPSGESST APGSTSESPSGTAPGTSPSGESSTAP GTSPSGESSTAPGSTSSTAESPGPGT SPSGESSTAPGTSPSGESSTAPGSTSS TAESPGPGTSTPESGSASPGTSTPES GSASPGTSESPSGTAPGSTSESPSG TAPGTSTPESGSASPGSTSSTAESPG PGTSTPESGSASPGTSESPSGTAPG TSPSGESSTAPGSTSSTAESPGPGTSP SGESSTAPGTSTPESGSASPGSTSST AESPGPGSTSSTAESPGPGSTSSTAE SPGPGSTSSTAESPGPGTSPSGESST APGSTSESPSGTAPGSTSESPSGTAP GTSTPESGPXXXGASASGAPSTXXX XSESPSGTAPGSTSESPSGTAPGSTS ESPSGTAPGSTSESPSGTAPGSTSESP SGTAPGSTSESPSGTAPGTSTPESGS ASPGTSPSGESSTAPGTSPSGESSTA PGSTSSTAESPGPGTSPSGESSTAPG TSTPESGSASPGSTSESPSGTAPGSTS ESPSGTAPGTSPSGESSTAPGSTSESP SGTAPGTSTPESGSASPGTSTPESGS ASPGSTSESPSGTAPGTSTPESGSAS PGSTSSTAESPGPGSTSESPSGTAPG STSESPSGTAPGTSPSGESSTAPGSTS STAESPGPGTSPSGESSTAPGTSTPES GSASPGTSPSGESSTAPGTSPSGESS TAPGTSPSGESSTAPGSTSSTAESPG PGSTSSTAESPGPGTSPSGESSTAPG SSPSASTGTGPGSSTPSGATGSPGSS TPSGATGSP | 731 | 875 | Residue totals: H: 2 E: 0 percent: H: 0.2 E: 0.0 | 95.20% |
| AG864 | GASPGTSSTGSPGSSPSASTGTGPGS SPSASTGTGPGTPGSGTASSSPGSST PSGATGSPGSSPSASTGTGPGASPGT SSTGSPGTPGSGTASSSPGSSTPSGA TGSPGTPGSGTASSSPGASPGTSSTG SPGASPGTSSTGSPGTPGSGTASSSP GSSTPSGATGSPGASPGTSSTGSPGT PGSGTASSSPGSSTPSGATGSPGSSP SASTGTGPGSSPSASTGTGPGSSTPS GATGSPGSSTPSGATGSPGASPGTSS TGSPGASPGTSSTGSPGASPGTSSTG SPGTPGSGTASSSPGASPGTSSTGSP GASPGTSSTGSPGASPGTSSTGSPGS SPSASTGTGPGTPGSGTASSSPGASP GTSSTGSPGASPGTSSTGSPGASPGT SSTGSPGSSTPSGATGSPGSSTPSGA TGSPGASPGTSSTGSPGTPGSGTASS SPGSSTPSGATGSPGSSTPSGATGSP GSSTPSGATGSPGSSPSASTGTGPGA SPGTSSTGSPGASPGTSSTGSPGTPG SGTASSSPGASPGTSSTGSPGASPGT SSTGSPGASPGTSSTGSPGASPGTSS TGSPGTPGSGTASSSPGSSTPSGATG SPGTPGSGTASSSPGSSTPSGATGSP | 732 | 864 | Residue totals: H: 0 E: 0 percent: H: 0.0 E: 0.0 | 94.91% |

TABLE 32-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GTPGSGTASSSPGSSTPSGATGSPGS STPSGATGSPGSSPSASTGTGPGSSP SASTGTGPGASPGTSSTGSPGTPGSG TASSSPGSSTPSGATGSPGSSPSAST GTGPGSSPSASTGTGPGASPGTSSTG SPGASPGTSSTGSPGSSTPSGATGSP GSSPSASTGTGPGASPGTSSTGSPGS SPSASTGTGPGTPGSGTASSSPGSST PSGATGSPGSSTPSGATGSPGASPGT SSTGSP | | | | |
| AM875 | GTSTEPSEGSAPGSEPATSGSETPGS PAGSPTSTEEGSTSSTAESPGPGTST PESGSASPGSTSESPSGTAPGSTSESP SGTAPGTSTPESGSASPGTSTPESGS ASPGSEPATSGSETPGTSESATPESG PGSPAGSPTSTEEGTSTEPSEGSAPG TSESATPESGPGTSTEPSEGSAPGTS TEPSEGSAPGSPAGSPTSTEEGTSTE PSEGSAPGTSTEPSEGSAPGTSESAT PESGPGTSESATPESGPGTSTEPSEG SAPGTSTEPSEGSAPGTSESATPESG PGTSTEPSEGSAPGSEPATSGSETPG SPAGSPTSTEEGSSTPSGATGSPGTP GSGTASSSPGSSTPSGATGSPGTSTE PSEGSAPGTSTEPSEGSAPGSEPATS GSETPGSPAGSPTSTEEGSPAGSPTS TEEGTSTEPSEGSAPGASASGAPSTG GTSESATPESGPGSPAGSPTSTEEGS PAGSPTSTEEGSTSSTAESPGPGSTS ESPSGTAPGTSPSGESSTAPGTPGSG TASSSPGSSTPSGATGSPGSSPSAST GTGPGSEPATSGSETPGTSESATPES GPGSEPATSGSETPGSTSSTAESPGP GSTSSTAESPGPGTSPSGESSTAPGS EPATSGSETPGSEPATSGSETPGTST EPSEGSAPGSTSSTAESPGPGTSTPES GSASPGSTSESPSGTAPGTSTEPSEG SAPGTSTEPSEGSAPGTSTEPSEGSA PGSSTPSGATGSPGSSPSASTGTGPG ASPGTSSTGSPGSEPATSGSETPGTS ESATPESGPGSPAGSPTSTEEGSSTPS GATGSPGSSPSASTGTGPGASPGTSS TGSPGTSESATPESGPGTSTEPSEGS APGTSTEPSEGSAP | 733 | 875 | Residue totals: H: 7 E: 3 percent: H: 0.8 E: 0.3 | 98.63% |
| AM1318 | GTSTEPSEGSAPGSEPATSGSETPGS PAGSPTSTEEGSTSSTAESPGPGTST PESGSASPGSTSESPSGTAPGSTSESP SGTAPGTSTPESGSASPGTSTPESGS ASPGSEPATSGSETPGTSESATPESG PGSPAGSPTSTEEGTSTEPSEGSAPG TSESATPESGPGTSTEPSEGSAPGTS TEPSEGSAPGSPAGSPTSTEEGTSTE PSEGSAPGTSTEPSEGSAPGTSESAT PESGPGTSESATPESGPGTSTEPSEG SAPGTSTEPSEGSAPGTSESATPESG PGTSTEPSEGSAPGSEPATSGSETPG SPAGSPTSTEEGSSTPSGATGSPGTP GSGTASSSPGSSTPSGATGSPGTSTE PSEGSAPGTSTEPSEGSAPGSEPATS GSETPGSPAGSPTSTEEGSPAGSPTS TEEGTSTEPSEGSAPGPEPTGPAPSG GSEPATSGSETPGTSESATPESGPGS PAGSPTSTEEGTSESATPESGPGSPA GSPTSTEEGSPAGSPTSTEEGTSESA TPESGPGSPAGSPTSTEEGSPAGSPT STEEGSTSSTAESPGPGSTSESPSGT APGTSPSGESSTAPGSTSESPSGTAP GSTSESPSGTAPGTSPSGESSTAPGT STEPSEGSAPGTSESATPESGPGTSE SATPESGPGSEPATSGSETPGTSESA TPESGPGTSESATPESGPGTSTEPSE GSAPGTSESATPESGPGTSTEPSEGS APGTSPSGESSTAPGTSPSGESSTAP | 734 | 1318 | Residue totals: H: 7 E: 0 percent: H: 0.7 E: 0.0 | 99.17% |

TABLE 32-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GTSPSGESSTAPGTSTEPSEGSAPGS PAGSPTSTEEGTSTEPSEGSAPGSSPS ASTGTGPGSSTPSGATGSPGSSTPSG ATGSPGSSTPSGATGSPGSSTPSGAT GSPGASPGTSSTGSPGASASGAPSTG GTSPSGESSTAPGSTSSTAESPGPGT SPSGESSTAPGTSESATPESGPGTST EPSEGSAPGTSTEPSEGSAPGSSPSA STGTGPGSSTPSGATGSPGASPGTSS TGSPGTSTPESGSASPGTSPSGESST APGTSPSGESSTAPGTSESATPESGP GSEPATSGSETPGTSTEPSEGSAPGS TSESPSGTAPGSTSESPSGTAPGTSTP ESGSASPGSPAGSPTSTEEGTSESAT PESGPGTSTEPSEGSAPGSPAGSPTS TEEGTSESATPESGPGSEPATSGSET PGSSTPSGATGSPGASPGTSSTGSPG SSTPSGATGSPGSTSESPSGTAPGTS PSGESSTAPGSTSSTAESPGPGSSTPS GATGSPGASPGTSSTGSPGTPGSGT ASSSPGSPAGSPTSTEEGSPAGSPTS TEEGTSTEPSEGSAP | | | | |
| AM923 | MAEPAGSPTSTEEGASPGTSSTGSP GSSTPSGATGSPGSSTPSGATGSPGT STEPSEGSAPGSEPATSGSETPGSPA GSPTSTEEGSTSSTAESPGPGTSTPES GSASPGSTSESPSGTAPGSTSESPSG TAPGTSTPESGSASPGTSTPESGSAS PGSEPATSGSETPGTSESATPESGPG SPAGSPTSTEEGTSTEPSEGSAPGTS ESATPESGPGTSTEPSEGSAPGTSTE PSEGSAPGSPAGSPTSTEEGTSTEPS EGSAPGTSTEPSEGSAPGTSESATPE SGPGTSESATPESGPGTSTEPSEGSA PGTSTEPSEGSAPGTSESATPESGPG TSTEPSEGSAPGSEPATSGSETPGSP AGSPTSTEEGSSTPSGATGSPGTPGS GTASSSPGSSTPSGATGSPGTSTEPS EGSAPGTSTEPSEGSAPGSEPATSGS ETPGSPAGSPTSTEEGSPAGSPTSTE EGTSTEPSEGSAPGASASGAPSTGG TSESATPESGPGSPAGSPTSTEEGSP AGSPTSTEEGSTSSTAESPGPGSTSE SPSGTAPGTSPSGESSTAPGTPGSGT ASSSPGSSTPSGATGSPGSSPSASTG TGPGSEPATSGSETPGTSESATPESG PGSEPATSGSETPGTSSTAESPGPG STSSTAESPGPGTSPSGESSTAPGSEP ATSGSETPGSEPATSGSETPGTSTEP SEGSAPGSTSSTAESPGPGTSTPESG SASPGSTSESPSGTAPGTSTEPSEGS APGTSTEPSEGSAPGTSTEPSEGSAP GSSTPSGATGSPGSSPSASTGTGPGA SPGTSSTGSPGSEPATSGSETPGTSES ATPESGPGSPAGSPTSTEEGSSTPSG ATGSPGSSPSASTGTGPGASPGTSST GSPGTSESATPESGPGTSTEPSEGSA PGTSTEPSEGSAP | 735 | 924 | Residue totals: H: 4 E: 3 percent: H: 0.4 E: 0.3 | 98.70% |
| AE912 | MAEPAGSPTSTEEGTPGSGTASSSP GSSTPSGATGSPGASPGTSSTGSPGS PAGSPTSTEEGTSESATPESGPGTST EPSEGSAPGSPAGSPTSTEEGTSTEP SEGSAPGTSTEPSEGSAPGTSESATP ESGPGSEPATSGSETPGSEPATSGSE TPGSPAGSPTSTEEGTSESATPESGP GTSTEPSEGSAPGTSTEPSEGSAPGS PAGSPTSTEEGTSTEPSEGSAPGTST EPSEGSAPGTSESATPESGPGTSTEP SEGSAPGTSESATPESGPGSEPATSG SETPGTSTEPSEGSAPGTSTEPSEGS APGTSESATPESGPGTSESATPESGP GSPAGSPTSTEEGTSESATPESGPGS EPATSGSETPGTSESATPESGPGTST | 736 | 913 | Residue totals: H: 8 E: 3 percent: H: 0.9 E: 0.3 | 99.45% |

TABLE 32-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | EPSEGSAPGTSTEPSEGSAPGTSTEP<br>SEGSAPGTSTEPSEGSAPGTSTEPSE<br>GSAPGTSTEPSEGSAPGSPAGSPTST<br>EEGTSTEPSEGSAPGTSESATPESGP<br>GSEPATSGSETPGTSESATPESGPGS<br>EPATSGSETPGTSESATPESGPGTST<br>EPSEGSAPGTSESATPESGPGSPAGS<br>PTSTEEGSPAGSPTSTEEGSPAGSPT<br>STEEGTSESATPESGPGTSTEPSEGS<br>APGTSESATPESGPGSEPATSGSETP<br>GTSESATPESGPGSEPATSGSETPGT<br>SESATPESGPGTSTEPSEGSAPGSPA<br>GSPTSTEEGTSESATPESGPGSEPAT<br>SGSETPGTSESATPESGPGSPAGSPT<br>STEEGSPAGSPTSTEEGTSTEPSEGS<br>APGTSESATPESGPGTSESATPESGP<br>GTSESATPESGPGSEPATSGSETPGS<br>EPATSGSETPGSPAGSPTSTEEGTST<br>EPSEGSAPGTSTEPSEGSAPGSEPAT<br>SGSETPGTSESATPESGPGTSTEPSE<br>GSAP | | | | |
| BC 864 | GTSTEPSEPGSAGTSTEPSEPGSAGS<br>EPATSGTEPSGSGASEPTSTEPGSEP<br>ATSGTEPSGSEPATSGTEPSGSEPAT<br>SGTEPSGSGASEPTSTEPGTSTEPSEP<br>GSAGSEPATSGTEPSGTSTEPSEPGS<br>AGSEPATSGTEPSGSEPATSGTEPSG<br>TSTEPSEPGSAGTSTEPSEPGSAGSE<br>PATSGTEPSGSEPATSGTEPSGTSEP<br>STSEPGAGSGASEPTSTEPGTSEPST<br>SEPGAGSEPATSGTEPSGSEPATSGT<br>EPSGTSTEPSEPGSAGTSTEPSEPGS<br>AGSGASEPTSTEPGSEPATSGTEPSG<br>SEPATSGTEPSGSEPATSGTEPSGSE<br>PATSGTEPSGTSTEPSEPGSAGSEPA<br>TSGTEPSGSGASEPTSTEPGTSTEPSE<br>PGSAGSEPATSGTEPSGSGASEPTST<br>EPGTSTEPSEPGSAGSGASEPTSTEP<br>GSEPATSGTEPSGSGASEPTSTEPGS<br>EPATSGTEPSGSGASEPTSTEPGTST<br>EPSEPGSAGSEPATSGTEPSGSGASE<br>PTSTEPGTSTEPSEPGSAGSEPATSG<br>TEPSGTSTEPSEPGSAGSEPATSGTE<br>PSGTSTEPSEPGSAGTSTEPSEPGSA<br>GTSTEPSEPGSAGTSTEPSEPGSAGT<br>STEPSEPGSAGTSTEPSEPGSAGTSE<br>PSTSEPGAGSGASEPTSTEPGTSTEP<br>SEPGSAGTSTEPSEPGSAGTSTEPSE<br>PGSAGSEPATSGTEPSGSGASEPTST<br>EPGSEPATSGTEPSGSEPATSGTEPS<br>GSEPATSGTEPSGSEPATSGTEPSGT<br>SEPSTSEPGAGSEPATSGTEPSGSGA<br>SEPTSTEPGTSTEPSEPGSAGSEPATS<br>GTEPSGSGASEPTSTEPGTSTEPSEP<br>GSA | 737 | | Residue totals: H: 0 E: 0<br>percent: H: 0 E: 0 | 99.77% |

* H: alpha-helix E: beta-sheet

Example 33

Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide.

The results, shown in Table 33, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 738), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

Conclusions: The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 33

Subsequence score calculations of polypeptide sequences

| Seq Name | Amino Acid Sequence | SEQ ID NO: | Score |
|---|---|---|---|
| J288 | GSGGEGGSGGEGGSGGEGGSGGEGGSGGEGGSGGEGGSGGEGGSGGEGGSGGEGG SGGEGGSGGEGGSGGEGGSGGEGGSGGEGGSGGEGGSGGEGGSGGEGGSGGEGGS GGEGGSGGEGGSGGEGGSGGEGGSGGEGGSGGEGGSGGEGGSGGEGGSGGEGGSG GEGGSGGEGGSGGEGGSGGEGGSGGEGGSGGEGGSGGEGGSGGEGGSGGEGGSGG EGGSGGEGGSGGEGGSGGEGGSGGEGGSGGEGGSGGEGGSGGEGGSGGEGGSGGE GGSGGEGGSGGEG | 739 | 33.3 |
| K288 | GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEG | 740 | 46.9 |
| L288 | SSESSESSSSESSSESSESSSSESSSESSESSSSESSSESSESSSSESSSESSESSSSESSSESS ESSSSESSSESSSSESSSESSSSESSSESSSSESSSESSSSESSSESSSSESSSESSESSSS ESSSESSESSSSESSSESSESSSSESSSESSESSSSESSSESSESSSSESSSESSSSESSSE SSESSSSESSSESSSSESSSESSSSESSSESSSSESSSESSSSESSSESSSSESSSESSSSESS SESSSESSSSESSSESSESSSSES | 741 | 50.0 |
| Y288 | GEGSGEGSEGEGSEGSGEGEGSEGSGEGEGGSEGSEGEGGSEGSEGEGS GEGSEGEGGSEGSEGEGSEGSEGSEGEGGSEGSEGEGSEGSEGSEGEGG SEGEGSEGSGEGEGSGEGSEGEGSEGSGEGEGSEGSGEGSEGSGEGEGSGEGE GGSEGSEGEGSEGSGEGEGGSEGSGEGEGSGEGSEGEGSEGSGEGEGSE GGSEGEGGSEGGEGEGSEGSGEGEGSEGGSEGEGSEGGSEGEGSEGSGEGEGSEGSGE | 742 | 26.8 |
| Q576 | GGKPGEGGKPEGGGGKPGGKPEGEGEGKPGGKPEGGGKPGGGEGGKPEGGKPEGE GKPGGGEGKPGGKPEGGGGKPEGEGKPGGGGKPGGKPEGEGKPGGGEGGKPEGK PGEGGEGKPGGKPEGGGEGKPGGGKPGEGGKPGEGKPGGGEGGKPEGGKPEGEGK PGGGEGKPGGKPGEGGKPEGGGEGKPGGKPEGGGEGKPGGGKPEGEGKPGGGKPG GGEGGKPEGEGKPGGKPEGGGEGKPGGKPEGGGKPEGGGEGKPGGGKPGEGGKPG EGEGKPGGKPEGEGKPGGEGGGKPEGKPGGGEGGKPEGGKPGEGGKPEGGKPGEG GEGKPGGGKPGEGGKPEGGGKPEGEGKPGGGGKPGEGGKPEGGKPEGGGEGKPGG GKPEGEGKPGGGEGKPGGKPEGGGGKPGEGGKPEGGKPGGEGGGKPEGEGKPGGK PGEGGGGKPGGKPEGEGKPGEGGEGKPGGKPEGGGEGKPGGKPEGGGEGKPGGGK PGEGGKPEGGGKPGEGGKPGEGGKPEGEGKPGGGEGKPGGKPGEGGKPEGGGEGK PGGKPGGEGGGKPEGGKPGEGGKPEG | 743 | 18.5 |
| U576 | GEGKPGGKPGSGGGKPGEGGKPGSGEGKPGGKPGSGGSGKPGGKPGEGGKPEGGSG GKPGGGGKPGGKPGGEGSGKPGGKPEGGGKPEGGSGGKPGGKPEGGSGGKPGGKP GSGEGGKPGGGKPGGEGKPGSGKPGGEGSGKPGGKPEGGSGGKPGGKPEGGSGGKP GGSGKPGGKPGEGGKPEGGSGGKPGGSGKPGGKPEGGGSGKPGGKPGEGGKPGSGE GGKPGGGKPGGKPGSGKPGGEGSGKPGGKPGSGGEGKPGGKPEGGSGGKPGGG KPGGEGKPGSGGKPGEGGKPGSGGGKPGGKPGGEGEGKPGGKPGEGGKPGGEGSG KPGGGGKPGGKPGEGGKPEGSGKPGGSGKPGGKPEGGGKPEGSGKPGGGKP EGSGKPGGGKPEGGSGGKPGGSGKPGGKPGEGGGKPEGSGKPGGGSGKPGGKPEGG GKPEGGSGGKPGGKPEGGSGGKPGGKPGGEGSGKPGGKPGSGEGGKPGGKPGEGSG GKPGGKPEGGSGGKPGGSGKPGGKPEGGGSGKPGGKPGEGGKPGGEGSGKPGGSG KPG | 744 | 18.1 |
| W576 | GGSGKPGKPGGSGSGKPGSGKPGGGSGKPGSGKPGGGSGKPGSGKPGGGSGKPGSG KPGGGGKPGSGSGKPGGGKPGGSGGKPGGGSGKPGKPGSGGSGKPGSGKPGGGSGG KPGKPGSGGSGGKPGKPGSGGGSGKPGKPGSGGSGGKPGKPGSGGSGGKPGKPGSG GSGKPGSGKPGGGSGKPGSGKPGSGGSGKPGKPGSGGSGKPGSGKPGSGSGKPGSG KPGGGSGKPGSGKPGSGGSGKPGKPGSGGGGKPGSGSGKPGGGKPGSGSGKPGGGKP GGSGKPGSGSGKPGKPGSGGGSGKPGKPGGSGSGKPGKPGSGGSGKPGSGKPGG GSGKPGSGKPGSGGSGKPGKPGSGGSGGKPGKPGSGGGKPGSGSGKPGGGKPGSGS | 745 | 23.4 |

TABLE 33-continued

Subsequence score calculations of polypeptide sequences

| Seq Name | Amino Acid Sequence | SEQ ID NO: | Score |
|---|---|---|---|
| | GKPGGGKPGSGSGKPGGGKPGSGSGKPGGSGKPGSGKPGGGSGGKPGKPGSGGSGK PGSGKPGSGGSGKPGKPGGSGSGKPGSGKPGGGSGKPGSGKPGGGSGKPGSGKPGG GSGKPGSGKPGGGGKPGSGSGKPGGSGGKPGKPGSGGSGGKPGKPGSGGSGKPGSG KPGGGSGGKPGKPGSGG | | |
| Y576 | GEGSGEGSEGEGSEGSGEGEGSEGSGEGEGGSEGSEGEGSEGSGEGGGEGSGEGEG SGEGSEGEGGGEGSEGEGSGEGGEGEGSEGGSEGGEGSEGSEGGEGEGSEGEGEG GSEGEGSEGGSEGSEGSEGGEGEGSEGSGEGEGSEGSGEGEGSEGSGEGEGGSEG EGGSEGSEGEGSGEGEGEGGSEGSEGEGGGEGSEGEGSGEGSEGEGGSEGSEGEGG SEGSEGEGGEGSGEGEGSEGSGEGEGSGEGSEGGEGEGSEGSGEGEGSEGSGEGE EGEGSGEGSEGSGEGEGSGEGSEGEGSGEGEGGSEGSEGEGGSEGSEGEGEGSEGE GSGEGEGGGEGSGEGEGSGEGSGEGEGGGEGSEGEGSEGSGEGEGSEGSGEGEGGS EGEGGSEGSEGEGSEGGSEGEGSEGGSEGEGSEGGSEGEGGEGSGEGEGGGEGSEGEGSEGSGEGEGSG EGSE | 746 | 15.7 |
| AD576 | GSSESGSSEGGPGSGGEPSESGSSGSSESGSSEGGPGSSESGSSEGGPGSSESGSSEGGP GSSESGSSEGGPGSSESGSSEGGPGESPGGSSGSESGSEGSSGPGESSGSSESGSSEGGP GSSESGSSEGGPGSSESGSSEGGPGSGGEPSESGSSGESPGGSSGSESGESPGGSSGSES GSGGEPSESGSSGSSESGSSEGGPGSGGEPSESGSSGSEGSSGPGESS GESPGGSSGSESGSGGEPSESGSSGSGGEPSESGSSGSESGSSEGGP GESPGGSGSESGESPGGSSGSESGESPGGSSGSESGESPGGSSGSESGESPGGSSGSES GSSESGSSEGGPGSGGEPSESGSSGSEGSSGPGESSGSSESGSSEGGPGSGGEPSESGSS GSSESGSSEGGPGSGGEPSESGSSGESPGGSSGSESGESPGGSSGSESGSSESGSSEGGP GSGGEPSESGSSGSESGSSEGGPGSGGEPSESGSSGESPGGSSGSES GSEGSSGPGESSGSSGSESGSSEGGPGSEGSSGPGESS | 747 | 13.6 |
| AE576 | AGSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAP GTSTEPSEGSAPGTSESATPESGPGTSTEPSEGSAPGTSESATPESGPGSEPATSGSETP GTSESATPESGPGTSTEPSEGSAPGTSESATPESGPGSPAGSPTSTEE GTSESATPESGPGSEPATSGSETPGTSESATPESGPGTSTEPSEGSAPGTSTEPSEGSAP GTSTEPSEGSAPGTSTEPSEGSAPGTSTEPSEGSAPGSPAGSPTSTEE GTSTEPSEGSAPGTSESATPESGPGSEPATSGSETPGTSESATPESGPGSEPATSGSETP GTSESATPESGPGTSTEPSEGSAPGTSESATPESGPGSPAGSPTSTEEGSPAGSPTSTEE GSPAGSPTSTEEGTSESATPESGPGTSTEPSEGSAP | 748 | 6.1 |
| AF540 | GSTSSTAESPGPGSTSSTAESPGPGSTSESPSGTAPGSTSSTAESPGPGSTSSTAESPGPG TSTPESGSASPGSTSESPSGTAPGTSPSGESSTAPGSTSESPSGTAPGSTSESPSGTAPGT SPSGESSTAPGSTSESPSGTAPGSTSESPSGTAPGTSPSGESSTAPGSTSESPSGTAPGST SESPSGTAPGSTSESPSGTAPGSTPESGSASPGSTSESPSGTAPGTSTPESGSASPGSTS STAESPGPGSTSSTAESPGPGTSTPESGSASPGTSTPESGSASPGSTSESPSGTAPGTSTP ESGSASPGTSTPESGSASPGSTSESPSGTAPGSTSESPSGTAPGSTSESPSGTAPGTSST AESPGPGTSTPESGSASPGTSTPESGSASPGSTSESPSGTAPGSTSESPSGTAPGTSTPES GSASPGSTSESPSGTAPGSTSESPSGTAPGTSTPESGSASPGTSPSGESSTAPGSTSSTAE SPGPGTSPSGESSTAPGSTSSTAESPGPGTSTPESGSASPGSTSESPSGTAP | 749 | 8.8 |
| AF504 | GASPGTSSTGSPGSSSPSASTGTGPGSSPSASTGTGPGTPGSGTASSSPGSSTPSGATGSP GSNPSASTGTGPGASPGTSSTGSPGTPGSGTASSSPGSSTPSGATGSPGTPGSGTASSSP GASPGTSSTGSPGASPGTSSTGSPGTPGSGTASSSPGSSTPSGATGSPGASPGTSSTGSP GTPGSGTASSSPGSSTPSGATGSPGSNPSASTGTGPGSSPSASTGTGPGTPGSGTASSSP GSSTPSGATGSPGASPGTSSTGSPGASPGTSSTGSPGASPGTSSTGSPGTPGSGTASSSP GASPGTSSTGSPGASPGTSSTGSPGASPGTSSTGSPGSSPSASTGTGPGTPGSGTASSSP GASPGTSSTGSPGASPGTSSTGSPGASPGTSSTGSPGSSTPSGATGSPGSSTPSGATGSP GASPGTSSTGSPGTPGSGTASSSPGSSTPSGATGSPGSSTPSGATGSPGSSTPSGATGSP GSSPSASTGTGPGASPGTSSTGSP | 750 | 7.0 |
| AE864 | GSPAGSPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAP GTSTEPSEGSAPGTSESATPESGPGSEPATSGSETPGSEPATSGSETP GTSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGSAP GTSTEPSEGSAPGTSTEPSEGSAPGTSTEPSEGSAPGTSTEPSEGSAPGSPAGSPTSTEE GTSTEPSEGSAPGTSESATPESGPGSEPATSGSETPGTSESATPESGPGSEPATSGSETP GTSESATPESGPGTSTEPSEGSAPGSPAGSPTSTEEGSPAGSPTSTEE GSPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTEE GTSESATPESGPGSEPATSGSETPGTSESATPESGPGSPAGSPTSTEEGSPAGSPTSTEE GTSTEPSEGSAPGTSESATPESGPGTSESATPESGPGTSESATPESGPGSEPATSGSETP GSEPATSGSETPGSPAGSPTSTEEGTSTEPSEGSAP | 751 | 6.1 |

TABLE 33-continued

Subsequence score calculations of polypeptide sequences

| Seq Name | Amino Acid Sequence | SEQ ID NO: | Score |
|---|---|---|---|
| AF864 | GSTSESPSGTAPGTSPSGESSTAPGSTSESPSGTAPGSTSESPSGTAPGTSTPESGSASPG<br>TSTPESGSASPGSTSESPSGTAPGSTSESPSGTAPGTSPSGESSTAPGSTSESPSGTAPGT<br>SPSGESSTAPGTSPSGESSTAPGSTSSTAESPGPGTSPSGESSTAPGTSPSGESSTAPGST<br>SSTAESPGPGTSTPESGSASPGTSTPESGSASPGSTSESPSGTAPGSTSESPSGTAPGTST<br>PESGSASPGSTSSTAESPGPGTSTPESGSASPGSTSESPSGTAPGTSPSGESSTAPGSTSS<br>TAESPGPGTSPSGESSTAPGTSTPESGSASPGSTSSTAESPGPGTSSTAESPGPGTSSST<br>AESPGPGTSSTAESPGPGTSPSGESSTAPGSTSESPSGTAPGSTSESPSGTAPGTSTPES<br>GPXXXGASASGAPSTXXXXSESPSGTAPGSTSESPSGTAPGSTSESPSGTAPGSTSESP<br>SGTAPGSTSESPSGTAPGSTSESPSGTAPGTSTPESGSASPGTSPSGESSTAPGTSPSGES<br>STAPGSTSSTAESPGPGTSPSGESSTAPGTSTPESGSASPGSTSESPSGTAPGSTSESPSG<br>TAPGTSPSGESSTAPGSTSESPSGTAPGTSTPESGSASPGTSTPESGSASPGSTSESPSGT<br>APGTSTPESGSASPGSTSSTAESPGPGTSESPSGTAPGSTSESPSGTAPGTSPSGESSTA<br>PGSTSSTAESPGPGTSPSGESSTAPGTSTPESGSASPGTSPSGESSTAPGTSPSGESSTAP<br>GTSPSGESSTAPGTSSTAESPGPGTSSTAESPGPGTSPSGESSTAPGSSPSASTGTGPG<br>SSTPSGATGSPGSSTPSGATGSP | 752 | 7.5 |
| AG868 | GGSPGASPGTSSTGSPGSSPSASTGTGPGSSPSASTGTGPGTPGSGTASSSPGSSTPSGA<br>TGSPGSNPSASTGTGPGASPGTSSTGSPGTPGSGTASSSPGSSTPSGATGSPGTPGSGT<br>ASSSPGASPGTSSTGSPGASPGTSSTGSPGTPGSGTASSSPGSSTPSGATGSPGASPGTS<br>STGSPGTPGSGTASSSPGSSTPSGATGSPGSNPSASTGTGPGSSPSASTGTGPGSSTPSG<br>ATGSPGSSTPSGATGSPGASPGTSSTGSPGASPGTSSTGSPGASPGTSSTGSPGTPGSGT<br>ASSSPGASPGTSSTGSPGASPGTSSTGSPGASPGTSSTGSPGSSPSASTGTGPGTPGSGT<br>ASSSPGASPGTSSTGSPGASPGTSSTGSPGASPGTSSTGSPGSSTPSGATGSPGSSTPSG<br>ATGSPGASPGTSSTGSPGTPGSGTASSSPGSSTPSGATGSPGSSTPSGATGSPGSSTPSG<br>ATGSPGSSPSASTGTGPGASPGTSSTGSPGASPGTSSTGSPGTPGSGTASSSPGASPGTS<br>STGSPGASPGTSSTGSPGASPGTSSTGSPGASPGTSSTGSPGTPGSGTASSSPGSSTPSG<br>ATGSPGTPGSGTASSSPGSSTPSGATGSPGTPGSGTASSSPGSSTPSGATGSPGSSTPSG<br>ATGSPGSSPSASTGTGPGSSPSASTGTGPGASPGTSSTGSPGTPGSGTASSSPGSSTPSG<br>ATGSPGSSPSASTGTGPGSSPSASTGTGPGASPGTSSTGSPGASPGTSSTGSPGSSTPSG<br>ATGSPGSSPSASTGTGPGASPGTSSTGSPGSSPSASTGTGPGTPGSGTASSSPGSSTPSG<br>ATGSPGSSTPSGATGSPGASPGTSSTGSP | 753 | 7.5 |
| AM875 | GTSTEPSEGSAPGSEPATSGSETPGSPAGSPTSTEEGSTSSTAESPGPGTSTPESGSASPG<br>STSESPSGTAPGSTSESPSGTAPGTSTPESGSASPGTSTPESGSASPGSEPATSGSETPGT<br>SESATPESGPGSPAGSPTSTEEGTSTEPSEGSAPGTSESATPESGPGTSTEPSEGSAPGTS<br>TEPSEGSAPGSPAGSPTSTEEGTSTEPSEGSAPGTSTEPSEGSAPGTSESATPESGPGTSE<br>SATPESGPGTSTEPSEGSAPGTSTEPSEGSAPGTSESATPESGPGTSTEPSEGSAPGSEP<br>ATSGSETPGSPAGSPTSTEEGSSTPSGATGSPGTPGSGTASSSPGSSTPSGATGSPGTST<br>EPSEGSAPGTSTEPSEGSAPGSEPATSGSETPGSPAGSPTSTEEGSPAGSPTSTEEGTSTE<br>PSEGSAPGASASGAPSTGGTSESATPESGPGSPAGSPTSTEEGSPAGSPTSTEEGSTSST<br>AESPGPGTSESPSGTAPGTSPSGESSTAPGTPGSGTASSSPGSSTPSGATGSPGSSPSAS<br>TGTGPGSEPATSGSETPGTSESATPESGPGSEPATSGSETPGTSSTAESPGPGTSSTA<br>ESPGPGTSPSGESSTAPGSEPATSGSETPGSEPATSGSETPGTSTEPSEGSAPGSTSSTAE<br>SPGPGTSTPESGSASPGSTSESPSGTAPGTSTEPSEGSAPGTSTEPSEGSAPGTSTEPSEG<br>SAPGSSTPSGATGSPGSSPSASTGTGPGASPGTSSTGSPGSEPATSGSETPGTSESATPE<br>SGPGSPAGSPTSTEEGSSTPSGATGSPGSSPSASTGTGPGASPGTSSTGSPGTSESATPE<br>SGPGTSTEPSEGSAPGTSTEPSEGSAP | 754 | 4.5 |
| AM1318 | GTSTEPSEGSAPGSEPATSGSETPGSPAGSPTSTEEGSTSSTAESPGPGTSTPESGSASPG<br>STSESPSGTAPGSTSESPSGTAPGTSTPESGSASPGTSTPESGSASPGSEPATSGSETPGT<br>SESATPESGPGSPAGSPTSTEEGTSTEPSEGSAPGTSESATPESGPGTSTEPSEGSAPGTS<br>TEPSEGSAPGSPAGSPTSTEEGTSTEPSEGSAPGTSTEPSEGSAPGTSESATPESGPGTSE<br>SATPESGPGTSTEPSEGSAPGTSTEPSEGSAPGTSESATPESGPGTSTEPSEGSAPGSEP<br>ATSGSETPGSPAGSPTSTEEGSSTPSGATGSPGTPGSGTASSSPGSSTPSGATGSPGTST<br>EPSEGSAPGTSTEPSEGSAPGSEPATSGSETPGSPAGSPTSTEEGSPAGSPTSTEEGTSTE<br>PSEGSAPGPEPTGPAPSGGSEPATSGSETPGTSESATPESGPGSPAGSPTSTEEGTSESA<br>TPESGPGSPAGSPTSTEEGSPAGSPTSTEEGTSESATPESGPGSPAGSPTSTEEGSPAGSP<br>TSTEEGSTSSTAESPGPGTSESPSGTAPGTSPSGESSTAPGSTSESPSGTAPGSTSESPS<br>GTAPGTSPSGESSTAPGTSTEPSEGSAPGTSESATPESGPGTSESATPESGPGSEPATSG<br>SETPGTSESATPESGPGTSESATPESGPGTSTEPSEGSAPGTSESATPESGPGTSTEPSEG<br>SAPGTSPSGESSTAPGTSPSGESSTAPGTSPSGESSTAPGTSTEPSEGSAPGSPAGSPTST<br>EEGTSTEPSEGSAPGSSPSASTGTGPGSSTPSGATGSPGSSTPSGATGSPGSSTPSGATG<br>SPGSSTPSGATGSPGASPGTSSTGSPGASASGAPSTGGTSPSGESSTAPGSTSSTAESPG<br>PGTSPSGESSTAPGTSESATPESGPGTSTEPSEGSAPGTSTEPSEGSAPGSSPSASTGTGP<br>GSSTPSGATGSPGASPGTSSTGSPGTSTPESGSASPGTSPSGESSTAPGTSPSGESSTAP<br>GTSESATPESGPGSEPATSGSETPGTSTEPSEGSAPGTSESPSGTAPGSTSESPSGTAPG<br>TSTPESGSASPGSPAGSPTSTEEGTSESATPESGPGTSTEPSEGSAPGSPAGSPTSTEEGT<br>SESATPESGPGSEPATSGSETPGSTPSGATGSPGASPGTSSTGSPGSSTPSGATGSPGS<br>TSESPSGTAPGTSPSGESSTAPGSTSSTAESPGPGSSTPSGATGSPGASPGTSSTGSPGTP<br>GSGTASSSPGSPAGSPTSTEEGSPAGSPTSTEEGTSTEPSEGSAP | 755 | 4.5 |

Example 34

Calculation of TEPITOPE Scores

TEPITOPE scores of 9mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 34 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 34 were added. The HLA*0101B score of a 9mer peptide with the sequence FDKLPRTSG (SEQ ID NO: 756) is the sum of 0, −1.3, 0, 0.9, 0, −1.8, 0.09, 0, 0.

To evaluate the TEPITOPE scores for long peptides one can repeat the process for all 9mer subsequences of the sequences. This process can be repeated for the proteins encoded by other HLA alleles. Tables 35-38 give pocket potentials for the protein products of HLA alleles that occur with high frequency in the Caucasian population.

TEPITOPE scores calculated by this method range from approximately −10 to +10. However, 9mer peptides that lack a hydrophobic amino acid (FKLMVWY) (SEQ ID NO: 757) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9mer subsequences will have TEPITOPEs in the range in the range of −1009 to −989. This method confirms that XTEN polypeptides may have few or no predicted T-cell epitopes.

TABLE 34

Pocket potential for HLA*0101B allele.

| Amino Acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −2.4 | — | −2.7 | −2 | — | −1.9 |
| E | −999 | 0.1 | −1.2 | −0.4 | — | −2.4 | −0.6 | — | −1.9 |
| F | 0 | 0.8 | 0.8 | 0.08 | — | −2.1 | 0.3 | — | −0.4 |
| G | −999 | 0.5 | 0.2 | −0.7 | — | −0.3 | −1.1 | — | −0.8 |
| H | −999 | 0.8 | 0.2 | −0.7 | — | −2.2 | 0.1 | — | −1.1 |
| I | −1 | 1.1 | 1.5 | 0.5 | — | −1.9 | 0.6 | — | 0.7 |
| K | −999 | 1.1 | 0 | −2.1 | — | −2 | −0.2 | — | −1.7 |
| L | −1 | 1 | 1 | 0.9 | — | −2 | 0.3 | — | 0.5 |
| M | −1 | 1.1 | 1.4 | 0.8 | — | −1.8 | 0.09 | — | 0.08 |
| N | −999 | 0.8 | 0.5 | 0.04 | — | −1.1 | 0.1 | — | −1.2 |
| P | −999 | −0.5 | 0.3 | −1.9 | — | −0.2 | 0.07 | — | −1.1 |
| Q | −999 | 1.2 | 0 | 0.1 | — | −1.8 | 0.2 | — | −1.6 |
| R | −999 | 2.2 | 0.7 | −2.1 | — | −1.8 | 0.09 | — | −1 |
| S | −999 | −0.3 | 0.2 | −0.7 | — | −0.6 | −0.2 | — | −0.3 |
| T | −999 | 0 | 0 | −1 | — | −1.2 | 0.09 | — | −0.2 |
| V | −1 | 2.1 | 0.5 | −0.1 | — | −1.1 | 0.7 | — | 0.3 |
| W | 0 | −0.1 | 0 | −1.8 | — | −2.4 | −0.01 | — | −1.4 |
| Y | 0 | 0.9 | 0.8 | −1.1 | — | −2 | 0.5 | — | −0.9 |

TABLE 35

Pocket potential for HLA*0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 2.3 | — | −2.4 | −0.6 | — | −0.6 |
| E | −999 | 0.1 | −1.2 | −1 | — | −1.4 | −0.2 | — | −0.3 |
| F | −1 | 0.8 | 0.8 | −1 | — | −1.4 | 0.5 | — | 0.9 |
| G | −999 | 0.5 | 0.2 | 0.5 | — | −0.7 | 0.1 | — | 0.4 |
| H | −999 | 0.8 | 0.2 | 0 | — | −0.1 | −0.8 | — | −0.5 |
| I | 0 | 1.1 | 1.5 | 0.5 | — | 0.7 | 0.4 | — | 0.6 |
| K | −999 | 1.1 | 0 | −1 | — | 1.3 | −0.9 | — | −0.2 |
| L | 0 | 1 | 1 | 0 | — | 0.2 | 0.2 | — | −0 |
| M | 0 | 1.1 | 1.4 | 0 | — | −0.9 | 1.1 | — | 1.1 |
| N | −999 | 0.8 | 0.5 | 0.2 | — | −0.6 | −0.1 | — | −0.6 |
| P | −999 | −0.5 | 0.3 | −1 | — | 0.5 | 0.7 | — | −0.3 |
| Q | −999 | 1.2 | 0 | 0 | — | −0.3 | −0.1 | — | −0.2 |
| R | −999 | 2.2 | 0.7 | −1 | — | 1 | −0.9 | — | 0.5 |
| S | −999 | −0.3 | 0.2 | 0.7 | — | −0.1 | 0.07 | — | 1.1 |
| T | −999 | 0 | 0 | −1 | — | 0.8 | −0.1 | — | −0.5 |
| V | 0 | 2.1 | 0.5 | 0 | — | 1.2 | 0.2 | — | 0.3 |
| W | −1 | −0.1 | 0 | −1 | — | −1.4 | −0.6 | — | −1 |
| Y | −1 | 0.9 | 0.8 | −1 | — | −1.4 | −0.1 | — | 0.3 |

TABLE 36

Pocket potential for HLA*0401B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 1.4 | — | −1.1 | −0.3 | — | −1.7 |
| E | −999 | 0.1 | −1.2 | 1.5 | — | −2.4 | 0.2 | — | −1.7 |
| F | 0 | 0.8 | 0.8 | −0.9 | — | −1.1 | −1 | — | −1 |
| G | −999 | 0.5 | 0.2 | −1.6 | — | −1.5 | −1.3 | — | −1 |
| H | −999 | 0.8 | 0.2 | 1.1 | — | −1.4 | 0 | — | 0.08 |
| I | −1 | 1.1 | 1.5 | 0.8 | — | −0.1 | 0.08 | — | −0.3 |
| K | −999 | 1.1 | 0 | −1.7 | — | −2.4 | −0.3 | — | −0.3 |
| L | −1 | 1 | 1 | 0.8 | — | −1.1 | 0.7 | — | −1 |
| M | −1 | 1.1 | 1.4 | 0.9 | — | −1.1 | 0.8 | — | −0.4 |
| N | −999 | 0.8 | 0.5 | 0.9 | — | 1.3 | 0.6 | — | −1.4 |
| P | −999 | −0.5 | 0.3 | −1.6 | — | 0 | −0.7 | — | −1.3 |
| Q | −999 | 1.2 | 0 | 0.8 | — | −1.5 | 0 | — | 0.5 |
| R | −999 | 2.2 | 0.7 | −1.9 | — | −2.4 | −1.2 | — | −1 |
| S | −999 | −0.3 | 0.2 | 0.8 | — | 1 | −0.2 | — | 0.7 |
| T | −999 | 0 | 0 | 0.7 | — | 1.9 | −0.1 | — | −1.2 |
| V | −1 | 2.1 | 0.5 | −0.9 | — | 0.9 | 0.08 | — | −0.7 |
| W | 0 | −0.1 | 0 | −1.2 | — | −1 | −1.4 | — | −1 |
| Y | 0 | 0.9 | 0.8 | −1.6 | — | −1.5 | −1.2 | — | −1 |

TABLE 37

Pocket potential for HLA*0701B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −1.6 | — | −2.5 | −1.3 | — | −1.2 |
| E | −999 | 0.1 | −1.2 | −1.4 | — | −2.5 | 0.9 | — | −0.3 |
| F | 0 | 0.8 | 0.8 | 0.2 | — | −0.8 | 2.1 | — | 2.1 |
| G | −999 | 0.5 | 0.2 | −1.1 | — | −0.6 | 0 | — | −0.6 |
| H | −999 | 0.8 | 0.2 | 0.1 | — | −0.8 | 0.9 | — | −0.2 |
| I | −1 | 1.1 | 1.5 | 1.1 | — | −0.5 | 2.4 | — | 3.4 |
| K | −999 | 1.1 | 0 | −1.3 | — | −1.1 | 0.5 | — | −1.1 |
| L | −1 | 1 | 1 | −0.8 | — | −0.9 | 2.2 | — | 3.4 |
| M | −1 | 1.1 | 1.4 | −0.4 | — | −0.8 | 1.8 | — | 2 |
| N | −999 | 0.8 | 0.5 | −1.1 | — | −0.6 | 1.4 | — | −0.5 |
| P | −999 | −0.5 | 0.3 | −1.2 | — | −0.5 | −0.2 | — | −0.6 |
| Q | −999 | 1.2 | 0 | −1.5 | — | −1.1 | 1.1 | — | −0.9 |

TABLE 37-continued

Pocket potential for HLA*0701B allele.

| Amino acid | P1 | P2 | P3 | P4 | P5 | P6 | P7 | P8 | P9 |
|---|---|---|---|---|---|---|---|---|---|
| R | −999 | 2.2 | 0.7 | −1.1 | — | −1.1 | 0.7 | — | −0.8 |
| S | −999 | −0.3 | 0.2 | 1.5 | — | 0.6 | 0.4 | — | −0.3 |
| T | −999 | 0 | 0 | 1.4 | — | −0.1 | 0.9 | — | 0.4 |
| V | −1 | 2.1 | 0.5 | 0.9 | — | 0.1 | 1.6 | — | 2 |
| W | 0 | −0.1 | 0 | −1.1 | — | −0.9 | 1.4 | — | 0.8 |
| Y | 0 | 0.9 | 0.8 | −0.9 | — | −1 | 1.7 | — | 1.1 |

TABLE 38

Pocket potential for HLA*1501B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −0.4 | — | −0.4 | −0.7 | — | −1.9 |
| E | −999 | 0.1 | −1.2 | −0.6 | — | −1 | −0.7 | — | −1.9 |
| F | −1 | 0.8 | 0.8 | 2.4 | — | −0.3 | 1.4 | — | −0.4 |
| G | −999 | 0.5 | 0.2 | 0 | — | 0.5 | 0 | — | −0.8 |
| H | −999 | 0.8 | 0.2 | 1.1 | — | −0.5 | 0.6 | — | −1.1 |
| I | 0 | 1.1 | 1.5 | 0.6 | — | 0.05 | 1.5 | — | 0.7 |
| K | −999 | 1.1 | 0 | −0.7 | — | −0.3 | −0.3 | — | −1.7 |
| L | 0 | 1 | 1 | 0.5 | — | 0.2 | 1.9 | — | 0.5 |
| M | 0 | 1.1 | 1.4 | 1 | — | 0.1 | 1.7 | — | 0.08 |
| N | −999 | 0.8 | 0.5 | −0.2 | — | 0.7 | 0.7 | — | −1.2 |
| P | −999 | −0.5 | 0.3 | −0.3 | — | −0.2 | 0.3 | — | −1.1 |
| Q | −999 | 1.2 | 0 | −0.8 | — | −0.8 | −0.3 | — | −1.6 |
| R | −999 | 2.2 | 0.7 | 0.2 | — | 1 | −0.5 | — | −1 |
| S | −999 | −0.3 | 0.2 | −0.3 | — | 0.6 | 0.3 | — | −0.3 |
| T | −999 | 0 | 0 | −0.3 | — | −0 | 0.2 | — | −0.2 |
| V | 0 | 2.1 | 0.5 | 0.2 | — | −0.3 | 0.3 | — | 0.3 |
| W | −1 | −0.1 | 0 | 0.4 | — | −0.4 | 0.6 | — | −1.4 |
| Y | −1 | 0.9 | 0.8 | 2.5 | — | 0.4 | 0.7 | — | −0.9 |

TABLE 39

Exemplary Biological Activity, Exemplary Assays and Preferred Indications

| Biologically Active Protein | Biological Activity | Exemplary Activity Assays | Preferred Indication: |
|---|---|---|---|
| Alpha-1-antitrypsin (Alpha-1 proteinase; Alpha-1-trypsin inhibitor; Prolastin; API; API Inhale) | Alpha-1-antitrypsin is an enzyme inhibitor that belongs to the family of serpin serine protease inhibitors. The molecule inhibits the activity of trypsin and elastase. | Enzyme Inhibition assay: Gaillard MC, Kilroe-Smith TA. 1987 Determination of functional activity of alpha 1-protease inhibitor and alpha 2-macroglobulin in human plasma using elastase. J Clin Chem Clin Biochem. 25(3): 167-72. Burnouf T, Constans J, Clerc A, Descamps J, Martinache L, Goudemand M. 1987 Biochemical and biological properties of an alpha 1-antitrypsin concentrate. Vox Sang; 52(4): 291-7; human leukocyte elastase (HLE) inhibitory capacity (Cantan, A, et al. Am, J. Resp. Cell Mol Biol. (2002) 27: 659-665 | Emphysema; chronic obstructive pulmonary disease (COPD); Infant Respiratory Distress Syndrome; Pulmonary Fibrosis; Respiratory Syncytial Virus Infections; Asthma; Cystic Fibrosis; Genitourinary Disorders; HIV Infections Treatment; Inflammatory Bowel Disorders; Skin Disorders; Viral Hepatitis; Alpha-1 Antitrypsin Deficiency; Adult Respiratory Distress Syndrome |

TABLE 40

Exemplary aaT-XTEN comprising aaT and terminal XTEN

| aaT-XTEN Name* | Amino Acid Sequence | SEQ ID NO: |
|---|---|---|
| AE48-aaT | MAEPAGSPTSTEEGTPGSGTASSSPGSSTPSGATGSPGASPGTSSTGSPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQK | 758 |
| AM48-aaT | MAEPAGSPTSTEEGASPGTSSTGSPGSSTPSGATGSPGSSTPSGATGSPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQK | 759 |
| AE144-aaT | GSEPATSGSETPGTSESATPESGPGSEPATSGSETPGSPAGSPTSTEEGTSTEPSEGSAPGSEP ATSGSETPGSEPATSGSETPGSEPATSGSETPGTSTEPSEGSAPGTSESATPESGPGSEPATSG SETPGTSTEPSEGSAPGEDPQGDAAQKTDTSHHDQDHPTFNKITPNLAEFAFSLYRQLAHQ SNSTNIFFSPVSIATAFAMLSLGTKADTHDEILEGLNFNLTEIPEAQIHEGFQELLRTLNQPDS QLQLTTGNGLFLSEGLKLVDKFLEDVKKLYHSEAFTVNFGDTEEAKKQINDYVEKGTQGK IVDLVKELDRDTVFALVNYIFFKGKWERPFEVKDTEEEDFHVDQVTTVKVPMMKRLGMF NIQHCKKLSSWVLLMKYLGNATAIFFLPDEGKLQHLENELTHDIITKFLENEDRRSASLHLP KLSITGTYDLKSVLGQLGITKVFSNGADLSGVTEEAPLKLSKAVHKAVLTIDEKGTEAAGA MFLEAIPMSIPPEVKFNKPFVFLMIEQNTKSPLFMGKVVNPTQK | 760 |
| AE288-aaT | GTSESATPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESATPESGP GSEPATSGSETPGSEPATSGSETPGSPAGSPTSTEEGTSESATPGTSTEPSEGSAPGSEP ATSGSETPGTSESATPESGPGTSTEPSEGSAPGEDPQGDAAQKTDTSHHDQDHPTFNKITPN LAEFAFSLYRQLAHQSNSTNIFFSPVSIATAFAMLSLGTKADTHDEILEGLNFNLTEIPEAQI HEGFQELLRTLNQPDSQLQLTTGNGLFLSEGLKLVDKFLEDVKKLYHSEAFTVNFGDTEE AKKQINDYVEKGTQGKIVDLVKELDRDTVFALVNYIFFKGKWERPFEVKDTEEEDFHVDQ VTTVKVPMMKRLGMFNIQHCKKLSSWVLLMKYLGNATAIFFLPDEGKLQHLENELTHDII TKFLENEDRRSASLHLPKLSITGTYDLKSVLGQLGITKVFSNGADLSGVTEEAPLKLSKAV HKAVLTIDEKGTEAAGAMFLEAIPMSIPPEVKFNKPFVFLMIEQNTKSPLFMGKVVNPTQK | 761 |
| AF144-aaT | GTSTPESGSASPGTSPSGESSTAPGTSPSGESSTAPGSTSSTAESPGPGSTSESPSGTAPGSTSS TAESPGPGTSPSGESSTAPGTSPESGSASPGTSSTAESPGPGTSPSGESSTAPGTSPSGESST APGTSPSGESSTAPGEDPQGDAAQKTDTSHHDQDHPTFNKITPNLAEFAFSLYRQLAHQSN STNIFFSPVSIATAFAMLSLGTKADTHDEILEGLNFNLTEIPEAQIHEGFQELLRTLNQPDSQ LQLTTGNGLFLSEGLKLVDKFLEDVKKLYHSEAFTVNFGDTEEAKKQINDYVEKGTQGKI VDLVKELDRDTVFALVNYIFFKGKWERPFEVKDTEEEDFHVDQVTTVKVPMMKRLGMF NIQHCKKLSSWVLLMKYLGNATAIFFLPDEGKLQHLENELTHDIITKFLENEDRRSASLHLP KLSITGTYDLKSVLGQLGITKVFSNGADLSGVTEEAPLKLSKAVHKAVLTIDEKGTEAAGA MFLEAIPMSIPPEVKFNKPFVFLMIEQNTKSPLFMGKVVNPTQK | 762 |
| AD576-aaT | GSSESGSSEGGPGSSGGEPSESGSSGSSESGSSEGGPGSSESGSSEGGPGSSESGSSEGGPGSSE SGSSEGGPGSSESGSSEGGPGESPGGSSGSESGSSGPGESSGSSEGGPGSSESGSS EGGPGSSGSSEGGPGSGGEPSESGSSGESPGSSGSSGESGSPGGSSGSESGSSGSS GEPSESGSSGSGGEPSESGSSGSSESGSSEGGPGESPGGSSGSESGSPGGS SGSESGSPGSSGSESGSPGGSSGSESGSPGGSSGSESGSSEGGPGSSGGEPSESGSS SGSESSGPGESSGSSESGSSEGGPGSSGGEPSESGSSGES PGGSSGSESGSPGGSSGSESGSSEGGPGSSGGEPSESGSSGSSESGSSEGGPGSSGGEPS ESGSSGSGGEPSESGSSGESPGGSSGSESGSEGSSGPGESSGSSESGSSEGGPGSEGSSGPGES SGEDPQGDAAQKTDTSHHDQDHPTFNKITPNLAEFAFSLYRQLAHQSNSTNIFFSPVSIATA FAMLSLGTKADTHDEILEGLNFNLTEIPEAQIHEGFQELLRTLNQPDSQLQLTTGNGLFLSE GLKLVDKFLEDVKKLYHSEAFTVNFGDTEEAKKQINDYVEKGTQGKIVDLVKELDRDTV FALVNYIFFKGKWERPFEVKDTEEEDFHVDQVTTVKVPMMKRLGMFNIQHCKKLSSWVL LMKYLGNATAIFFLPDEGKLQHLENELTHDIITKFLENEDRRSASLHLPKLSITGTYDLKSV LGQLGITKVFSNGADLSGVTEEAPLKLSKAVHKAVLTIDEKGTEAAGAMFLEAIPMSIPPE VKFNKPFVFLMIEQNTKSPLFMGKVVNPTQK | 763 |
| AE576-aaT | GSPAGSPTSTEEGTSESATPESGPGSTSTEPSEGSAPGSPAGSPTSTEEGTSTEPSEGSAPGTST EPSEGSAPGTSESATPESGPGSEPATSGSETPGSEPATSGSETPGSPAGSPTSTEEGTSESATP ESGPGTSTEPSEGSAPGTSTEPSEGSAPGSPAGSPTSTEEGTSTEPSEGSAPGTSTEPSEGSAP GTSESATPESGPGTSTEPSEGSAPGTSESATPESGPGSEPATSGSETPGTSTEPSEGSAPGTST EPSEGSAPGTSESATPESGPGTSESATPESGPGSPAGSPTSTEEGTSESATPESGPGSEPATSG SETPGTSESATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSTEPSEGSAPGTSESATPESGPGSEP | 764 |

TABLE 40-continued

Exemplary aaT-XTEN comprising aaT and terminal XTEN

| aaT-XTEN Name* | Amino Acid Sequence | SEQ ID NO: |
|---|---|---|
| | ATSGSETPGTSESATPESGPGSEPATSGSETPGTSESATPESGPGTSTEPSEGSAPGTSESATP<br>ESGPGSPAGSPTSTEEGSPAGSPTSTEEGSPAGSPTSTEEGTSESATPESGPGTSTEPSEGSAP<br>GEDPQGDAAQKTDTSHHDQDHPTFNKITPNLAEFAFSLYRQLAHQSNSTNIFFSPVSIATAF<br>AMLSLGTKADTHDEILEGLNFNLTEIPEAQIHEGFQELLRTLNQPDSQLQLTTGNGLFLSEG<br>LKLVDKFLEDVKKLYHSEAFTVNFGDTEEAKKQINDYVEKGTQGKIVDLVKELDRDTVF<br>ALVNYIFFKGKWERPFEVKDTEEEDFHVDQVTTVKVPMMKRLGMFNIQHCKKLSSWVLL<br>MKYLGNATAIFFLPDEGKLQHLENELTHDIITKFLENEDRRSASLHLPKLSITGTYDLKSVL<br>GQLGITKVFSNGADLSGVTEEAPLKLSKAVHKAVLTIDEKGTEAAGAMFLEAIPMSIPPEV<br>KFNKPFVFLMIEQNTKSPLFMGKVVNPTQK | |
| AF576-aaT | GSTSSTAESPGPGSTSSTAESPGPGSTSESPSGTAPGSTSSTAESPGPGSTSSTAESPGPGTSTP<br>ESGSASPGSTSESPSGTAPGTSPSGESSTAPGSTSESPSGTAPGSTSESPSGTAPGTSPSGESST<br>APGSTSESPSGTAPGSTSESPSGTAPGTSPSGESSTAPGSTSESPSGTAPGSTSESPSGTAPGST<br>SESPSGTAPGTSTPESGSASPGSTSESPSGTAPGTSTPESGSASPGSTSSTAESPGPGSTSSTAE<br>SPGPGTSTPESGSASPGTSTPESGSASPGSTSESPSGTAPGSTSTPESGSASPGTSTPESGSASPG<br>STSESPSGTAPGSTSESPSGTAPGSTSESPSGTAPGSTSSTAESPGPGTSTPESGSASPGTSTPE<br>SGSASPGSTSESPSGTAPGSTSESPSGTAPGTSTPESGSASPGSTSESPSGTAPGSTSESPSGTA<br>PGTSTPESGSASPGTSPSGESSTAPGSTSSTAESPGPGTSPSGESSTAPGSTSSTAESPGPGTST<br>PESGSASPGSTSESPSGTAPGSTSSTAESPGPGTSTPESGSASPGTSTPESGSASPGEDPQGDA<br>AQKTDTSHHDQDHPTFNKITPNLAEFAFSLYRQLAHQSNSTNIFFSPVSIATAFAMLSLGTK<br>ADTHDEILEGLNFNLTEIPEAQIHEGFQELLRTLNQPDSQLQLTTGNGLFLSEGLKLVDKFL<br>EDVKKLYHSEAFTVNFGDTEEAKKQINDYVEKGTQGKIVDLVKELDRDTVFALVNYIFFK<br>GKWERPFEVKDTEEEDFHVDQVTTVKVPMMKRLGMFNIQHCKKLSSWVLLMKYLGNAT<br>AIFFLPDEGKLQHLENELTHDIITKFLENEDRRSASLHLPKLSITGTYDLKSVLGQLGITKVF<br>SNGADLSGVTEEAPLKLSKAVHKAVLTIDEKGTEAAGAMFLEAIPMSIPPEVKFNKPFVFL<br>MIEQNTKSPLFMGKVVNPTQK | 765 |
| AE624-aaT | MAEPAGSPTSTEEGTPGSGTASSSPGSSTPSGATGSPGASPGTSSTGSPGSPAGSPTSTEEGT<br>SESATPESGPGTSTEPSEGSAPGSPAGSPTSTEEGTSTEPSEGSAPGTSTEPSEGSAPGTSESA<br>TPESGPGSEPATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSTEPSEGSAPGTSESATPESGPGT<br>STEPSEGSAPGTSESATPESGPGSEPATSGSETPGTSTEPSEGSAPGTSTEPSEGSAPGTSESA<br>TPESGPGTSESATPESGPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPGT<br>STEPSEGSAPGSPAGSPTSTEEGTSTEPSEGSAPGTSESATPESGPGSEPATSGSETPGTSESA<br>TPESGPGSEPATSGSETPGSESATPESGPGTSTEPSEGSAPGTSESATPESGPGSPAGSPTST<br>EEGSPAGSPTSTEEGSPAGSPTSTEEGTSESATPESGPGTSTEPSEGSAPGEDPQGDAAQKTD<br>TSHHDQDHPTFNKITPNLAEFAFSLYRQLAHQSNSTNIFFSPVSIATAFAMLSLGTKADTHD<br>EILEGLNFNLTEIPEAQIHEGFQELLRTLNQPDSQLQLTTGNGLFLSEGLKLVDKFLEDVKK<br>LYHSEAFTVNFGDTEEAKKQINDYVEKGTQGKIVDLVKELDRDTVFALVNYIFFKGKWER<br>PFEVKDTEEEDFHVDQVTTVKVPMMKRLGMFNIQHCKKLSSWVLLMKYLGNATAIFFLP<br>DEGKLQHLENELTHDIITKFLENEDRRSASLHLPKLSITGTYDLKSVLGQLGITKVFSNGAD<br>LSGVTEEAPLKLSKAVHKAVLTIDEKGTEAAGAMFLEAIPMSIPPEVKFNKPFVFLMIEQNT<br>KSPLFMGKVVNPTQK | 766 |
| AD836-aaT | GSSESGSSEGGPGSSESGSSEGGPGESPGGSSGSESGSGGGEPSESGSSGESPGGSSGSESGESP<br>GGSSGSESGSSESGSSEGGPGSSESGSSEGGPGSSESGSSEGGPGESPGGSSGSESGESPGGSS<br>GSESGESPGGSSGSESGSSESGSSEGGPGSSESGSSEGGPGSSESGSSEGGPGSSESGSSEGGP<br>GSSESGSSEGGPGSSESGSSEGGPGSGGEPSESGSSGESPGGSSGSESGESPGGSSGSESGSG<br>GEPSESGSSGSESGSGPGESSGSSESGSSEGGPGSGGEPSESGSSGSEGSSGPGESSGSSESGS<br>SEGGPGSGGEPSESGSSGESPGGSSGSESGSGGEPSESGSSGSGGEPSESGSSGSSESGSSEGG<br>PGSGGEPSESGSSGSGGEPSESGSSGESGSSEGGPGSSESGSSGPGESSGESPGGSSGESSGSE<br>GSSGPGESSGSGGEPSESGSSGSSESGSSEGGPGSSESGSSEGGPGESSGSGGEPSESGSSGSE<br>GSSGPGESSGSEGSSGPGESSGSEGSSGPGESSGSGGEPSESGSSGSGGEPSESGSSGESPGGS<br>SGESGESPGGSSGSESGSGGEPSESGSSGSESGSGPGESSGESPGGSSGSESGSSESGSSEGG<br>PGSSESGSSEGGPGSSESGSSEGGPGSGGEPSESGSSGESPGGSSGSESGSGGEPSESGSSGSE<br>GEPSESGSSGSESGSSEGGPGESPGGSSGSESGSGGEPSESGSSGESPGGSSGSESGSGGEPS<br>ESGSSGEDPQGDAAQKTDTSHHDQDHPTFNKITPNLAEFAFSLYRQLAHQSNSTNIFFSPVS<br>IATAFAMLSLGTKADTHDEILEGLNFNLTEIPEAQIHEGFQELLRTLNQPDSQLQTTGNGL<br>FLSEGLKLVDKFLEDVKKLYHSEAFTVNFGDTEEAKKQINDYVEKGTQGKIVDLVKELDR<br>DTVFALVNYIFFKGKWERPFEVKDTEEEDFHVDQVTTVKVPMMKRLGMFNIQHCKKLSS<br>WVLLMKYLGNATAIFFLPDEGKLQHLENELTHDIITKFLENEDRRSASLHLPKLSITGTYDL<br>KSVLGQLGITKVFSNGADLSGVTEEAPLKLSKAVHKAVLTIDEKGTEAAGAMFLEAIPMSI<br>PPEVKFNKPFVFLMIEQNTKSPLFMGKVVNPTQK | 767 |
| AE864-aaT | GSPAGSPTSTEEGTSESATPESGPGTSTEPSEGSAPGSPAGSPTSTEEGTSTEPSEGSAPGTST<br>EPSEGSAPGTSESATPESGPGSEPATSGSETPGSEPATSGSETPGSPAGSPTSTEEGTSESATP<br>ESGPGTSTEPSEGSAPGTSTEPSEGSAPGSPAGSPTSTEEGTSTEPSEGSAPGTSESATPESGP<br>GTSESATPESGPGTSTEPSEGSAPGTSESATPESGPGSEPATSGSETPGTSTEPSEGSAPGTST<br>EPSEGSAPGTSESATPESGPGTSESATPESGPGSPAGSPTSTEEGTSESATPESGPGSEPATSG<br>SETPGTSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESGPGSEP<br>ATSGSETPGTSESATPESGPGSEPATSGSETPGTSESATPESGPGTSTEPSEGSAPGTSESATP | 768 |

TABLE 40-continued

Exemplary aaT-XTEN comprising aaT and terminal XTEN

| aaT-XTEN Name* | Amino Acid Sequence | SEQ ID NO: |
|---|---|---|
| | ESGPGSPAGSPTSTEEGSPAGSPTSTEEGSPAGSPTSTEEGTSESATPESGPGTSTEPSEGSAP GTSESATPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPGSEP ATSGSETPGTSESATPESGPGTSTEPSEGSAPGEDPQGDAAQKTDTSHHDQDHPTFNKITPN LAEFAFSLYRQLAHQSNSTNIFFSPVSIATAFAMLSLGTKADTHDEILEGLNFNLTEIPEAQI HEGFQELLRTLNQPDSQLQLTTGNGLFLSEGLKLVDKFLEDVKKLYHSEAFTVNFGDTEE AKKQINDYVEKGTQGKIVDLVKELDRDTVFALVNYIFFKGKWERPFEVKDTEEEDFHVDQ VTTVKVPMMKRLGMFNIQHCKKLSSWVLLMKYLGNATAIFFLPDEGKLQHLENELTHDII TKFLENEDRRSASLHLPKLSITGTYDLKSVLGQLGITKVFSNGADLSGVTEEAPLKLSKAV HKAVLTIDEKGTEAAGAMFLEAIPMSIPPEVKFNKPFVFLMIEQNTKSPLFMGKVVNPTQK | |
| AF864-aaT | GSTSESPSGTAPGTSPSGESSTAPGSTSESPSGTAPGSTSESPSGTAPGTSTPESGSASPGTSTP ESGSASPGSTSESPSGTAPGSTSESPSGTAPGTSPSGESSTAPGSTSESPSGTAPGTSPSGESST APGTSPSGESSTAPGSTSSTAESPGPGTSPSGESSTAPGTSPSGESSTAPGSTSSTAESPGPGTS TPESGSASPGTSTPESGSASPGSTSESPSGTAPGSTSESPSGTAPGTSTPESGSASPGTSSTAE SPGPGTSTPESGSASPGSTSESPSGTAPGTSPSGESSTAPGSTSSTAESPGPGTSPSGESSTAPG TSTPESGSASPGSTSSTAESPGPGTSTSSTAESPGPGTSTSSTAESPGPGTSPSG ESSTAPGSTSESPSGTAPGSTSESPSGTAPGTSTPESGPXXXGASASGAPSTXXXXXSESPSGT APGSTSESPSGTAPGSTSESPSGTAPGSTSESPSGTAPGSTSESPSGTAPGSTSESPSGTAPGTS TPESGSASPGTSPSGESSTAPGTSPSGESSTAPGSTSSTAESPGPGTSPSGESSTAPGTSTPESG SASPGSTSESPSGTAPGSTSESPSGTAPGTSPSGESSTAPGSTSESPSGTAPGTSTPESGSASPG TSTPESGSASPGSTSESPSGTAPGTSTPESGSASPGSTSES PSGTAPGTSPSGESSTAPGSTSSTAESPGPGTSPSGESSTAPGTSTPESGSASPGTSPSGESSTA PGTSPSGESSTAPGTSPSGESSTAPGSTSSTAESPGPGTSSTAESPGPGTSPSGESSTAPGSSP SASTGTGPGSSTPSGATGSPGSSTPSGATGSPGEDPQGDAAQKTDTSHHDQDHPTFNKITPN LAEFAFSLYRQLAHQSNSTNIFFSPVSIATAFAMLSLGTKADTHDEILEGLNFNLTEIPEAQI HEGFQELLRTLNQPDSQLQLTTGNGLFLSEGLKLVDKFLEDVKKLYHSEAFTVNFGDTEE AKKQINDYVEKGTQGKIVDLVKELDRDTVFALVNYIFFKGKWERPFEVKDTEEEDFHVDQ VTTVKVPMMKRLGMFNIQHCKKLSSWVLLMKYLGNATAIFFLPDEGKLQHLENELTHDII TKFLENEDRRSASLHLPKLSITGTYDLKSVLGQLGITKVFSNGADLSGVTEEAPLKLSKAV HKAVLTIDEKGTEAAGAMFLEAIPMSIPPEVKFNKPFVFLMIEQNTKSPLFMGKVVNPTQK | 769 |
| AG864-aaT | GASPGTSSTGSPGSSPSASTGTGPGSSPSASTGTGPGSSPSASTGTGPGSSPSGATSSSPGSSTPSGATGSPGSNP SASTGTGPGASPGTSSTGSPGTPGSGTASSSPGSSTPSGATGSPGTPGSGTASSSPGASPGTSS TGSPGASPGTSSTGSPGTPGSGTASSSPGSSTPSGATGSPGASPGTSSTGSPGTPGSGTASSSP GSSTPSGATGSPGSNPSASTGTGPGSSPSASTGTGPGSSTPSGATGSPGSSTPSGATGSPGAS PGTSSTGSPGASPGTSSTGSPGASPGTSSTGPGTPGSGTASSSPGASPGTSSTGSPGASPGTSSTGS PGASPGTSSTGSPGSSTPSGATGSPGSSTPSGATGSPGASPGTSSTGSPGTPGSGTASSSPGSS TPSGATGSPGSSTPSGATGSPGSSTPSGATGSPGSSPSASTGTGPGASPGTSSTGSPGASPGTS STGSPGTPGSGTASSSPGASPGTSSTGSPGASPGTSSTGSPGASPGTSSTGSPGASPGTSSTGS PGTPGSGTASSSPGSSTPSGATGSPGTPGSGTASSSPGSSTPSGATGSPGTPGSGTASSSPGSS TPSGATGSPGSSTPSGATGSPGSSPSASTGTGPGTASSSPGSSPSASTGTGPGASPGTSSTGPGTPGSG TASSSPGSSTPSGATGSPGSSPSASTGTGPGSSPSASTGTGPGASPGTSSTGSPGASPGTSSTG SPGSSTPSGATGSPGSSPSASTGTGPGASPGTSSTGSPGSSPSASTGTGPGTPGSGTASSSPGS STPSGATGSPGSSTPSGATGSPGASPGTSSTGSPGEDPQGDAAQKTDTSHHDQDHPTFNKIT PNLAEFAFSLYRQLAHQSNSTNIFFSPVSIATAFAMLSLGTKADTHDEILEGLNFNLTEIPEA QIHEGFQELLRTLNQPDSQLQLTTGNGLFLSEGLKLVDKFLEDVKKLYHSEAFTVNFGDTE EAKKQINDYVEKGTQGKIVDLVKELDRDTVFALVNYIFFKGKWERPFEVKDTEEEDFHVD QVTTVKVPMMKRLGMFNIQHCKKLSSWVLLMKYLGNATAIFFLPDEGKLQHLENELTHD IITKFLENEDRRSASLHLPKLSITGTYDLKSVLGQLGITKVFSNGADLSGVTEEAPLKLSKA VHKAVLTIDEKGTEAAGAMFLEAIPMSIPPEVKFNKPFVFLMIEQNTKSPLFMGKVVNPTQK | 770 |
| AM875-aaT | GTSTEPSEGSAPGSEPATSGSETPGSPAGSPTSTEEGSTSSTAESPGPGTSTPESGSASPGSTS ESPSGTAPGSTSESPSGTAPGTSTPESGSASPGTSTPESGSASPGSEPATSGSETPGTSESATPE SGPGSPAGSPTSTEEGTSTEPSEGSAPGTSESATPESGPGTSTEPSEGSAPGTSTEPSEGSAPG SPAGSPTSTEEGTSTEPSEGSAPGTSTEPSEGSAPGTSESATPESGPGTSESATPESGPGTSTE PSEGSAPGTSTEPSEGSAPGTSESATPESGPGTSESATPESGPGSEPATSGSETPGSPAGSPTS TEEGSSTPSGATGSPGTPGSGTASSSPGSSTPSGATGSPGTSTEPSEGSAPGTSTEPSEGSAPG SEPATSGSETPGSPAGSPTSTEEGSPAGSPTSTEEGTSTEPSEGSAPGASASGAPSTGGTSESA TPESGPGSPAGSPTSTEEGSPAGSPTSTEEGTSSTAESPGPGTSESPSGTAPGTSPSGESSTA PGTSPSGTASSSPGSSTPSGATGSPGSSPSASTGTGPGSEPATSGSETPGTSESATPESGPGSE PATSGSETPGSSTAESPGPGTSSTAESPGPGTSSTAPGSSTAPGSEPATS GSETPGTSTEPSEGSAPGSSTAESPGPGTSTPESGSASPGTSESPSGTAPGTSTEPSEGSAP GTSTEPSEGSAPGTSTEPSEGSAPGSSTPSGATGSPGSSPSASTGTGPGASPGTSSTGSPGSEP ATSGSETPGTSESATPESGPGSPAGSPTSTEEGSSTPSGATGSPGSSPSASTGTGPGASPGTSS TGSPGTSESATPESGPGTSTEPSEGSAPGTSTEPSEGSAPGEDPQGDAAQKTDTSHHDQDHP TFNKITPNLAEFAFSLYRQLAHQSNSTNIFFSPVSIATAFAMLSLGTKADTHDEILEGLNFNL TEIPEAQIHEGFQELLRTLNQPDSQLQLTTGNGLFLSEGLKLVDKFLEDVKKLYHSEAFTV | 771 |

TABLE 40-continued

Exemplary aaT-XTEN comprising aaT and terminal XTEN

| aaT-XTEN Name* | Amino Acid Sequence | SEQ ID NO: |
|---|---|---|
| | NFGDTEEAKKQINDYVEKGTQGKIVDLVKELDRDTVFALVNYIFFKGKWERPFEVKDTEE EDFHVDQVTTVKVPMMKRLGMFNIQHCKKLSSWVLLMKYLGNATAIFFLPDEGKLQHLE NELTHDIITKFLENEDRRSASLHLPKLSITGTYDLKSVLGQLGITKVFSNGADLSGVTEEAPL KLSKAVHKAVETIDEKGTEAAGAMFLEAIPMSIPPEVKFNKPFVFLMIEQNTKSPLFMGKV VNPTQK | |
| AE912-aaT | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGSEPATSGSETPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQK | 772 |
| AM923-aaT | MAEPAGSPTSTEEGASPGTSSTGSPGSSTPSGATGSPGSSTPSGATGSPGTSTEPSEGSAPGS EPATSGSETPGSPAGSPTSTEEGSTSSTAESPGPGTSTPESGSASPGSTSESPSGTAPGSTSESP SGTAPGTSTPESGSASPGTSTPESGSASPGSEPATSGSETPGTSESATPESGPGSPAGSPTSTE EGTSTEPSEGSAPGTSESATPESGPGTSTEPSEGSAPGSPAGSPTSTEEGTS TEPSEGSAPGTSTEPSEGSAPGTSESATPESGPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTSTPGSGTASSSPGSSTPSGATGSPGTSTEPSEGSAPGTSTEPSEGSAPGSEPATSGSETPGSP AGSPTSTEEGSPAGSPTSTEEGTSTEPSEGSAPGASASGASPTSGTSESATPESGPGSPAGSP TSTEEGSPAGSPTSTEEGSTSSTAESPGPGTSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGTSSTAESPGPGTSPSGESSTAPGSEPATSGSETPGSEPATSGSETPGTSTEPSE GSAPGSTSSTAESPGPGTSTPESGSASPGSTSESPSGTAPGTSTEPSEGSAPGTSTEPSEGSAP GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGEDPQGDAAQKTDTSHHDQDHPTFNKITPNLAEF AFSLYRQLAHQSNSTNIFFSPVSIATAFAMLSLGTKADTHDEILEGLNFNLTEIPEAQIHEGF QELLRTLNQPDSQLQLTTGNGLFLSEGLKLVDKFLEDVKKLYHSEAFTVNFGDTEEAKKQI NDYVEKGTQGKIVDLVKELDRDTVFALVNYIFFKGKWERPFEVKDTEEEDFHVDQVTTV KVPMMKRLGMFNIQHCKKLSSWVLLMKYLGNATAIFFLPDEGKLQHLENELTHDIITKFL ENEDRRSASLHLPKLSITGTYDLKSVLGQLGITKVFSNGADLSGVTEEAPLKLSKAVHKAV LTIDEKGTEAAGAMFLEAIPMSIPPEVKFNKPFVFLMIEQNTKSPLFMGKVVNPTQK | 773 |
| aaT-AE144 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGSEPATSGSETPGTSESATPESGPGSEPA TSGSETPGSPAGSPTSTEEGTSTEPSEGSAPGSEPATSGSETPGSEPATSGS ETPGTSTEPSEGSAPGTSESATPESGPGSEPATSGSETPGTSTEPSEGSAP | 774 |
| aaT-AE288 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGSEPATSGSETPGSPAGSPTSTEEGTSES ATPESGPGSEPATSGSETPGTSESATPESGPGSPAGSPTSTEEGTSESATPE SGPGSEPATSGSETPGTSESATPESGPGSPAGSPTSTEEGSPAGSPTSTEEGTSTEPSEGSAPG TSESATPESGPGTSESATPESGPGTSESATPESGPGSEPATSGSETPGSEPATSGSETPGSPAG SPTSTEEGTSTEPSEGSAPGTSTEPSEGSAPGSEPATSGSETPGTSESATPESGPGTSTEPSEGS AP | 775 |

TABLE 40-continued

Exemplary aaT-XTEN comprising aaT and terminal XTEN

| aaT-XTEN Name* | Amino Acid Sequence | SEQ ID NO: |
|---|---|---|
| aaT-AF144 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGTSTPESGSASPGTSPSGESSTAPGTSPS GESSTAPGSTSSTAESPGPGSTSESPSGTAPGSTSSTAESPGPGTSPSGESSTAPGTSTPESGS ASPGSTSSTAESPGPGTSPSGESSTAPGTSPSGESSTAPGTSPSGESSTAP | 776 |
| aaT-AD576 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGSSESGSSEGGPGSSGEPSESGSSGSSES GSSEGGPGSSESGSSEGGPGSSESGSSEGGPGSSSESGSSEGGPGESPGGSS GSESGSEGSSGPGESSGSSEGGPGSSESGSSEGGPGSSGGEPSESGSS GESPGGSSGSESGESPGGSSGSESGSGGEPSESGSSGSSESGSSEGGPGSSGGEPSESGSSGSG GEPSESGSSGEGSSGPGESSGESPGGSSGSESGSGGEPSESGSSGSGGEPSESGSSGSGGEPS ESGSSGSSESGSSEGGPGESPGGSSGSESGESPGGSSGSESGESPGGSSGSESGESPGGSSGSE SGESPGGSSGSSESGSSEGGPGSSGGEPSESGSSGSEGGPGSSGGEPSESGSSGSEGGPGSG GEPSESGSSGSSESGSSEGGPGSGGEPSESGSSGSEGGPGSSGSESGESPGGSSGSESGSESGS SEGGPGSSGGEPSESGSSGSSESGSSEGGPGSGGEPSESGSSGSGGEPSESGSSGESPGGSSGSE SGSEGSSGPGESSGSSESGSSEGGPGSEGSSGPGESS | 777 |
| aaT-AE576 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGSPAGSPTSTEEGTSESATPESGPGTSTE PSEGSAPGSPAGSPTSTEEGTSTEPSEGSAPGTSTEPSEGSAPGTSESATPESGPGSEPATSGS ETPGSEPATSGSETPGSPAGSPTSTEEGTSESATPESGPGTSTEPSEGSAPGTSTEPSEGSAPG SPAGSPTSTEEGTSTEPSEGSAPGTSTEPSEGSAPGTSESATPESGPGTSTEPSEGSAPGTSES ATPESGPGSEPATSGSETPGTSTEPSEGSAPGTSTEPSEGSAPGTSESATPESGPGTSESATPE SGPGSPAGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAPPAG SPTSTEEGTSTEPSEGSAPGTSESATPESGPGSEPATSGSETPGTSESATPESGPGSEPATSGS ETPGTSESATPESGPGTSTEPSEGSAPGTSESATPESGPGSPAGSPTSTEEGSPAGSPTSTEEG SPAGSPTSTEEGTSESATPESGPGTSTEPSEGSAP | 778 |
| aaT-AF576 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGSTSSTAESPGPGSTSSTAESPGPGSTSE SPSGTAPGSTSSTAESPGPGSTSSTAESPGPGTSTPESGSASPGSTSPSGESSTAPGTSPSGESST APGSTSESPSGTAPGSTSESPSGTAPGTSPSGESSTAPGTSSESPSGTAPGSTSESPSGTAPGTS PSGESSTAPGSTSESPSGTAPGSTSESPSGTAPGSTSESPSGTAPGTSTPESGSASPGSTSESPS GTAPGSTSTPESGSASPGSTSSTAESPGPGSTSSTAESPGPGTSTPESGSASPGTSTPESGSASP GSTSESPSGTAPGSTSTPESGSASPGSTSTPESGSASPGSTSESPSGTAPGSTSESPSGTAPGSTSE SPSGTAPGSTSSTAESPGPGSTSTPESGSASPGTSTSESPSGSASPGTSTPESGSASPGTSESPSGTAPGSTSESPSGTAPGST APGSTSTPESGSASPGSTSESPSGTAPGSTSESPSGTAPGTSTPESGSASPGTSPSGESSTAPGST SSTAESPGPGTSPSGESSTAPGTSSTAESPGPGTSTPESGSASPGSTSESPSGTAPGSTSSTAE SPGPGTSTPESGSASPGTSTPESGSASP | 779 |
| aaT-AE624 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQLTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGMAEPAGSPTSTEEGTPGSGTASSSPGSS TPSGATGSPGASPGSTSTGSPGSPAGSPTSTEEGTSESATPESGPGSTSEPSEGSAPGSPAGSP TSTEEGTSTEPSEGSAPGTSTEPSEGSAPGTSESATPESGPGSEPATSGSETPGSEPATSGSET PGSPAGSPTSTEEGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSESATPESGPGSEPATS GSETPGTSTEPSEGSAPGTSTEPSEGSAPGTSESATPESGPGTSESATPESGPGSPAGSPTSTE EGTSESATPESGPGSEPATSGSETPGTSESATPESGPGTSTEPSEGSAPGTSTEPSEGSAPGTS | 780 |

TABLE 40-continued

Exemplary aaT-XTEN comprising aaT and terminal XTEN

| aaT-XTEN Name* | Amino Acid Sequence | SEQ ID NO: |
|---|---|---|
| | TEPSEGSAPGTSTEPSEGSAPGTSTEPSEGSAPGTSTEPSEGSAPGSPAGSPTSTEEGTSTEPS<br>EGSAPGTSESATPESGPGSEPATSGSETPGTSESATPESGPGSEPATSGSETPGTSESATPESG<br>PGTSTEPSEGSAPGTSESATPESGPGSPAGSPTSTEEGSPAGSPTSTEEGSPAGSPTSTEEGTS<br>ESATPESGPGTSTEPSEGSAP | |
| aaT-AD836 | MAEDPQGDAAQKTDTSHHDQDHPTFNKITPNLAEFAFSLYRQLAHQSNSTNIFFSPVSIAT<br>AFAMLSLGTKADTHDEILEGLNFNLTEIPEAQIHEGFQELLRTLNQPDSQLQLTTGNGLFLS<br>EGLKLVDKFLEDVKKLYHSEAFTVNFGDTEEAKKQINDYVEKGTQGKIVDLVKELDRDT<br>VFALVNYIFFKGKWERPFEVKDTEEEDFHVDQVTTVKVPMMKRLGMFNIQHCKKLSSWV<br>LLMKYLGNATAIFFLPDEGKLQHLENELTHDIITKFLENEDRRSASLHLPKLSITGTYDLKS<br>VLGQLGITKVFSNGADLSGVTEEAPLKLSKAVHKAVLTIDEKGTEAAGAMFLEAIPMSIPP<br>EVKFNKPFVFLMIEQNTKSPLFMGKVVNPTQKGGSSESGSSEGGPGSSESGSSEGGPGESPG<br>GSSSGSESGSGGEPSESGSSGESPGGSSGSESGESPGGSSGSESGSSESGSSEGGPGSSESGSSE<br>GGPGSSESGSSEGGPGESPGGSSGSESGESPGGSSGSESGESPGGSSGSESGSSESGSSEGGP<br>GSSESGSSGGPGSSESGSSEGGPGSSESGSSEGGPGSSESGSSEGGPGSG<br>GEPSESGSSGESPGGSSGSESGESPGGSSGSESGSGGEPSESGSSGSEGSSGPGESSGSSESGS<br>SEGGPGSGGEPSESGSSGSEGSSGPGESSGSSESGSSEGGPGSGGEPSESGSSGESPGGSSGSE<br>SGSGGEPSESGSSGSGGEPSESGSSGSSESGSSEGGPGSGGEPSESGSSGSGGEPSESGSSGSE<br>GSSGPGESSGESPGGSSGSESGSSGPGESSGSESSGPGGEPSESGSSGSSESGSSESGS<br>SEGGPGSSESGSSEGGPGESPGGSSGSESGSSGGEPSESGSSGSEGSSGPGESSGESPGGSSGSE<br>SGSSEGSSGPGSSESGSSEGGPGSGGEPSESGSSGSEGSSGPGESSGSEGSSGPGESSGSEGSSG<br>PGESSGSGGEPSESGSSGSGGEPSESGSSGESPGGSSGSESGESPGGSSGSESGSGGEPSESGS<br>SGESSGSSGPGESSGESPGGSSGSESGSSGPGESSGSESSGPGGPGSSESGSSEGGPGSG<br>GEPSESGSSGESPGGSSGSESGSSGGEPSESGSSGSESGSSESGSSEGGPGESPGGS<br>SGSESGSGGEPSESGSSGESPGGSGSESGSGGEPSESGSS | 781 |
| aaT-AE864 | MAEDPQGDAAQKTDTSHHDQDHPTFNKITPNLAEFAFSLYRQLAHQSNSTNIFFSPVSIAT<br>AFAMLSLGTKADTHDEILEGLNFNLTEIPEAQIHEGFQELLRTLNQPDSQLQLTTGNGLFLS<br>EGLKLVDKFLEDVKKLYHSEAFTVNFGDTEEAKKQINDYVEKGTQGKIVDLVKELDRDT<br>VFALVNYIFFKGKWERPFEVKDTEEEDFHVDQVTTVKVPMMKRLGMFNIQHCKKLSSWV<br>LLMKYLGNATAIFFLPDEGKLQHLENELTHDIITKFLENEDRRSASLHLPKLSITGTYDLKS<br>VLGQLGITKVFSNGADLSGVTEEAPLKLSKAVHKAVLTIDEKGTEAAGAMFLEAIPMSIPP<br>EVKFNKPFVFLMIEQNTKSPLFMGKVVNPTQKGGSPAGSPTSTEEGTSESATPESGPGTSTE<br>PSEGSAPGSPAGSPTSTEEGTSTEPSEGSAPGTSTEPSEGSAPGTSESATPESGPGSEPATSGS<br>ETPGSEPATSGSETPGSPAGSPTSTEEGTSESATPESGPGTSTEPSEGSAPGTSTEPSEGSAPG<br>SPAGSPTSTEEGTSTEPSEGSAPGTSTEPSEGSAPGTSESATPESGPGTSTEPSEGSAPGSES<br>ATPESGPGSEPATSGSETPGTSTEPSEGSAPGTSTEPSEGSAPGTSESATPESGPGTSESATPE<br>SGPGSPAGSPTSTEEGTSESATPESGPGSEPATSGSETPGTSESATPESGPGTSTEPSEGSAPG<br>TSTEPSEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEPATSGS<br>ETPGTSESATPESGPGTSTEPSEGSAPGTSESATPESGPGSPAGSPTSTEEGSPAGSPTSTEEG<br>SPAGSPTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSESATPE<br>SGPGSEPATSGSETPGTSESATPESGPGSPAGSPTSTEEGSPAGSPTSTEEGTSEPSEGSAP<br>TSESATPESGPGTSESATPESGPGTSESATPESGPGSEPATSGSETPGSEPATSGSETPGSPAG<br>SPTSTEEGTSTEPSEGSAPGTSTEPSEGSAPGSEPATSGSETPGTSESATPESGPGTSTEPSEGS<br>AP | 782 |
| aaT-AF864 | MAEDPQGDAAQKTDTSHHDQDHPTFNKITPNLAEFAFSLYRQLAHQSNSTNIFFSPVSIAT<br>AFAMLSLGTKADTHDEILEGLNFNLTEIPEAQIHEGFQELLRTLNQPDSQLQLTTGNGLFLS<br>EGLKLVDKFLEDVKKLYHSEAFTVNFGDTEEAKKQINDYVEKGTQGKIVDLVKELDRDT<br>VFALVNYIFFKGKWERPFEVKDTEEEDFHVDQVTTVKVPMMKRLGMFNIQHCKKLSSWV<br>LLMKYLGNATAIFFLPDEGKLQHLENELTHDIITKFLENEDRRSASLHLPKLSITGTYDLKS<br>VLGQLGITKVFSNGADLSGVTEEAPLKLSKAVHKAVLTIDEKGTEAAGAMFLEAIPMSIPP<br>EVKFNKPFVFLMIEQNTKSPLFMGKVVNPTQKGGSTSESPSGTAPGTSPSGESSTAPGSTSE<br>SPSGTAPGSTSESPSGTAPGTSTPESGSASPGTSTPESGSASPGSTSESPSGTAPGSTSESPSGT<br>APGTSPSGESSTAPGSTSESPSGTAPGTSPSGESSTAPGTSPSGESSTAPGSTSSTAESPGPGTS<br>PSGESSTAPGTSPSGESSTAPGSTSSTAESPGPGTSTPESGSASPGTSTPESGSASPGSTSESPS<br>GTAPGSTSESPSGTAPGTSTPESGSASPGSTSSTAESPGPGTSTPESGSASPGSTSESPSGTAP<br>GTSPSGESSTAPGSTSSTAESPGPGTSPSGESSTAPGTSTPESGSASPGSTSSTAESPGPGSTSS<br>TAESPGPGSTSSTAESPGPGSTSSTAESPGPGTSPSGESSTAPGSTSESPSGT<br>APGTSTPESGPXXXGASASGAPSTXXXXSESPSGTAPGSTSESPSGTAPGSTSESPSGTAPGS<br>TSESPSGTAPGSTSESPSGTAPGSTSESPSGTAPGTSTPESGSASPGTSPSGESSTAPGTSPSGE<br>SSTAPGSTSSTAESPGPGTSPSGESSTAPGTSTPESGSASPGSTSESPSGTAPGSTSESPSGTAP<br>GTSPSGESSTAPGSTSESPSGTAPGTSTPESGSASPGSTSESPSGTAPGSTSESPSGTAPGSTP<br>ESGSASPGSTSSTAESPGPGSTSESPSGTAPGSTSESPSGTAPGSTSPSGESSTAPGSTSSTAESP<br>GPGTSPSGESSTAPGTSTPESGSASPGTSPSGESSTAPGSTSPSGESSTAPGTSPSGESSTAPGST<br>SSTAESPGPGSTSSTAESPGPGTSPSGESSTAPGSSPSASTGTGPGSSTPSGATGSPGSSTPSG<br>ATGSP | 783 |
| aaT-AG864 | MAEDPQGDAAQKTDTSHHDQDHPTFNKITPNLAEFAFSLYRQLAHQSNSTNIFFSPVSIAT<br>AFAMLSLGTKADTHDEILEGLNFNLTEIPEAQIHEGFQELLRTLNQPDSQLQLTTGNGLFLS<br>EGLKLVDKFLEDVKKLYHSEAFTVNFGDTEEAKKQINDYVEKGTQGKIVDLVKELDRDT<br>VFALVNYIFFKGKWERPFEVKDTEEEDFHVDQVTTVKVPMMKRLGMFNIQHCKKLSSWV | 784 |

TABLE 40-continued

Exemplary aaT-XTEN comprising aaT and terminal XTEN

| aaT-XTEN Name* | Amino Acid Sequence | SEQ ID NO: |
|---|---|---|
| | LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGASPGTSSTGSPGSSPSASTGTGPGSSPS ASTGTGPGTPGSGTASSSPGSSTPSGATGSPGSNPSASTGTGPGASPGTSSTGSPGTPGSGTA SSSPGSSTPSGATGSPGTPGSGTASSSPGASPGTSSTGSPGASPGTSSTGSPGTPGSGTASSSP GSSTPSGATGSPGASPGTSSTGSPGTPGSGTASSSPGSSTPSGATGSPGSNPSASTGTGPGSSP SASTGTGPGSSTPSGATGSPGSSTPSGATGSPGASPGTSSTGSPGASPGTSSTGSPGASPGTSS TGSPGTPGSGTASSSPGASPGTSSTGSPGASPGTSSTGSPGASPGTSSTGSPGSSPSASTGTGP GTPGSGTASSSPGASPGTSSTGSPGASPGTSSTGSPGASPGTSSTGSPGSSTPSGATGSPGSST PSGATGSPGASPGTSSTGSPGTPGSGTASSSPGSSTPSGATGSPGSSTPSGATGSPGSSTPSGA TGSPGSSPSASTGTGPGASPGTSSTGSPGASPGTSSTGSPGASPGTSSTGSPGASPGTSSTGSP GASPGTSSTGSPGASPGTSSTGSPGASPGTSSTGSPGTPGSGTASSSPGSSTPSGATGSPGTPG SGTASSSPGSSTPSGATGSPGTPGSGTASSSPGSSTPSGATGSPGSSTPSGATGSPGSSPSAST GTGPGSSPSASTGTGPGASPGTSSTGSPGTPGSGTASSSPGSSTPSGATGSPGSSPSASTGTGP GSSPSASTGTGPGASPGTSSTGSPGASPGTSSTGSPGSSTPSGATGSPGSSPSASTGTGPGASP GTSSTGSPGSSPSASTGTGPGTPGSGTASSSPGSSTPSGATGSPGSSTPSGATGSPGASPGTSS TGSP | |
| aaT-AM875 | MAEDPQGDAAQKTDTSHHDQDHPTFNKITPNLAEFAFSLYRQLAHQSNSTNIFFSPVSIAT AFAMLSLGTKADTHDEILEGLNFNLTEIPEAQIHEGFQELLRTLNQPDSQLQTTGNGLFLS EGLKLVDKFLEDVKKLYHSEAFTVNFGDTEEAKKQINDYVEKGTQGKIVDLVKELDRDT VFALVNYIFFKGKWERPFEVKDTEEEDFHVDQVTTVKVPMMKRLGMFNIQHCKKLSSWV LLMKYLGNATAIFFLPDEGKLQHLENELTHDIITKFLENEDRRSASLHLPKLSITGTYDLKS VLGQLGITKVFSNGADLSGVTEEAPLKLSKAVHKAVLTIDEKGTEAAGAMFLEAIPMSIPP EVKFNKPFVFLMIEQNTKSPLFMGKVVNPTQKGGTSTEPSEGSAPGSEPATSGSETPGSPAG SPTSTEEGSTSSTAESPGPGTSTPESGSASPGSTSESPSGTAPGSTSESPSGTAPGTSTPESGSA SPGTSTPESGSASPGSEPATSGSETPGTSESATPESGPGSPAGSPTSTEEGTSTEPSEGSAPGT SESATPESGPGTSTEPSEGSAPGTSTEPSEGSAPGSPAGSPTSTEEGTSTEPSEGSAPGTSTEPS EGSAPGTSESATPESGPGTSESATPESGPGTSTEPSEGSAPGTSTEPSEGSAPGTSESATPESG PGTSTEPSEGSAPGSEPATSGSETPGSPAGSPTSTEEGSSTPSGATGSPGTPGSGTASSSPGSS TPSGATGSPGTSTEPSEGSAPGTSTEPSEGSAPGSEPATSGSETPGSPAGSPTSTEEGSPAGSP TSTEEGTSTEPSEGSAPGASASGAPSTGGTSESATPESGPGSPAGSPTSTEEGSPAGSPTSTEE GSTSSTAESPGPGSTSESPSGTAPGTSPSGESSTAPGTPGSGTASSSPGSSTPSGATGSPGSSPS ASTGTGPGSEPATSGSETPGTSESATPESGPGSEPATSGSETPGTSSTAESPGPGSTSSTAES PGPGTSPSGESSTAPGSEPATSGSETPGSEPATSGSETPGTSTEPSEGSAPGSTSSTAESPGPG TSTPESGSASPGSTSESPSGTAPGTSTEPSEGSAPGTSTEPSEGSAPGTSTEPSEGSAPGSSTPS GATGSPGSSPSASTGTGPGASPGTSSTGSPGSEPATSGSETPGTSESATPESGPGSPAGSPTST EEGSSTPSGATGSPGSSPSASTGTGPGASPGTSSTGSPGTSESATPESGPGTSTEPSEGSAPGT STEPSEGSAP | 785 |
| AE912-bovine aaT | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSTEPSEGSAPGSPAGSPTSTEEGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGTSESATPESGPGSEPATSGSETPGS EPATSGSETPGSPAGSPTSTEEGTSTEPSEGSAPGSEPATSGSETPGTSESA TPESGPGTSTEPSEGSAPGGVLQGHAVQETDDTSHQEAACHKIAPNLANFAFSIYHHLAHQ SNTSNIFFSPVSIASAFAMLSLGAKGNTHTEILKGLGFNLTELAEAEIHKGFQHLLHTLNQP NHQLQLTTGNGLFINESAKLVDTFLEDVKNLYHSEAFSINFRDAEEAKKKINDYVEKGSHG KIVELVKVLDPNTVFALVNYISFKGKWEKPFEMKHTTERDFHVDEQTTVKVPMMNRLGM FDLHYCDKLASWVLLLDYVGNVTACFILPDLGKLQQLEDKLNNELLAKFLEKKYASSAN LHLPKLSISETYDLKSVLGDVGITEVFSDRADLSGITKEQPLKVSKALHKAALTIDEKGTEA VGSTFLEAIPMSLPPDVEFNRPPLCILYDRNTKSPLFVGKVVNPTQA | 786 |
| AM923-pig aaT | MAEPAGSPTSTEEGASPGTSSTGSPGSSTPSGATGSPGSSTPSGATGSPGTPGSGTASSSPGSS TPSGATGSPGSSPSASTGTGPGASPGTSSTGSPGSSPSASTGTGPGASPGTSSTGSPGASPGTSS TGSPGSSPSASTGTGPGASPGTSSTGSPGSSPSASTGTGPGASPGTSSTGSPGASPGTSSTGSPGSSPSASTGTGPGASPGTSSTGSPGSPAGSPTSTEEGSPAGSPTSTEEGTSSTAESPGPGTSTPESGSASPGSTSESPSGTAPGSTSESP SGTAPGTSTPESGSASPGSTPESGSASPGSEPATSGSETPGSPAGSPTSTEE EGTSTEPSEGSAPGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTPGSGTASSSPGSSTPSGATGSPGTSTEPSEGSAPGSEPATSGSETPGSP AGSPTSTEEGSPAGSPTSTEEGTSTEPSEGSAPGASASGAPSTGGTSESATPESGPGSPAGSP TSTEEGSPAGSPTSTEEGSTSSTAESPGPGSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGSTSSTAESPGPGTSPSGESSTAPGSEPATSGSETPGSEPATSGSETPGTSTEPSE GSAPGSTSSTAESPGPGTSTPESGSASPGSTSESPSGTAPGTSTEPSEGSAPGTSTEPSEGSAP | 787 |

TABLE 40-continued

Exemplary aaT-XTEN comprising aaT and terminal XTEN

| aaT-XTEN Name* | Amino Acid Sequence | SEQ ID NO: |
|---|---|---|
| | GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGEGLQGHAVQETDVPRHDHEQHQEAACHRIAPN LADFAFSLYRQVARQSNTSNIFLSPVTIARAFAMLSLGTKGATHAEILEGLQFNLTEKAEAE IHEGFQHLLHTLNQPDNQLQLTTGNGLFIDEKAKLVPKFLEDVKNLYHSEAFSINFRDTEE AKKCINDYVEKGSQGKIVDLVDELDKDTVFALVNYIFFKGKWEKPFEVEQTTEEDFHVDE ETTVKVPMMNRLGMFDLHHCDKLSSWVLLMDYVATATAFFILPDQGKLHQLEDMLTKEI RAKFLEKRYPSSANLHLPKLTISGTYDLKSLLGNLGITKVFSDEADLSGVTEEQPLKLSKAL HRAVLTIDEKGTEATGATILEAIPMSIPPNVKFNKPFLFLIYDTKTKAVLFMGKVMNPTQ | |
| Baboon aaT-AE864 | GEDPQGDAAQKTDTPPHDQNHPTLNKITPSLAEFAFSLYRQLAHQSNSTNIFFSPVSIATAF AMLSLGTKADTHSEILEGLNFNLTEIPEAQVHEGFQELLRTLNKPDSQLQLTTGNGLFLNK SLKVVDKFLEDVKNLYHSEAFSVNFEDTEEAKKQINNYVEKGTQGKVVDLVKELDRDTV FALVNYIFFKGKWERPFEVEATEEEDFHVDQATTVKVPMMRRLGMFNIYHCEKLSSWVL LMKYLGNATAIFFLPDEGKLQHLENELTHDIITKFLENENRRSANLHLPKLAITGTYDLKTV LGHLGITKVFSNGADLSGVTEDAPLKLSKAVHKAVLTIDEKGTEAAGAMFLEAIPMSIPPE VKFNKPFVFLMIEQNTKSPLFIGKVVNPTQKGGSPAGSPTSTEEGTSESATPESGPGTSTEPS EGSAPGSPAGSPTSTEEGTSTEPSEGSAPGTSTEPSEGSAPGTSESATPESGPGSEPATSGSET PGSEPATSGSETPGSPAGSPTSTEEGTSESATPESGPGTSTEPSEGSAPGTSTEPSEGSAPGSP AGSPTSTEEGTSTEPSEGSAPGTSTEPSEGSAPGTSESATPESGPGTSTEPSEGSAPGTSESAT PESGPGSEPATSGSETPGTSTEPSEGSAPGTSTEPSEGSAPGTSESATPESGPGTSESATPESG PGSPAGSPTSTEEGTSESATPESGPGSEPATSGSETPGTSESATPESGPGTSTEPSEGSAPGTS TEPSEGSAPGTSTEPSEGSAPGTSTEPSEGSAPGTSTEPSEGSAPGSPAGSP TSTEEGTSTEPSEGSAPGTSESATPESGPGSEPATSGSETPGTSESATPESGPGSEPATSGSET PGTSESATPESGPGTSTEPSEGSAPGTSESATPESGPGSPAGSPTSTEEGSPAGSPTSTEEGSP AGSPTSTEEGTSESATPESGPGTSTEPSEGSAPGTSESATPESGPGSEPATSGSETPGTSESAT PESGPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAPGTS ESATPESGPGTSESATPESGPGTSESATPESGPGSEPATSGSETPGSEPATSGSETPGSPAGSP TSTEEGTSTEPSEGSAPGTSTEPSEGSAPGSEPATSGSETPGTSESATPESGPGTSTEPSEGSAP | 788 |
| aaT variant-AF864 | GMPSSVSWGILLLAGLCCLVPVSLAEDPQGDAAQKTDTSHHDQDHPTFNKITPNLAEFAFS LYRQLAHQSNSTNIFFSPVSIATAFAMLSLGTKADTHDEILEGLNFNLTEIPEAQIHEGFQEL LRTLNQPDSQLQLTTGNGLFLSEGLKLVDKFLEDVKKLYHSEAFTVNFGDTEEAKKQIND YVEKGTQGKIVDLVKELDRDTVFALVNYIFFKGKWERPFEVKDTEEEDPHVDQATTVKVP MMKRLGMFNIQHCKKLSSWVLLMKYLGNATAIFFLPDEGKLQHLENELTHDIITKFLENE DRRSASLHLPKLSITGTYDLKSVLGQLGITKVFSNGADLSGVTEEAPLKLSKAVHKAVLTI DRGHVFRGHTHVYPPRGQVQQTLCLLNDGGSTSESPSGTAPGTSPSGESSTAPGSTSESPSG TAPGSTSESPSGTAPGTSTPESGSASPGTSTPESGSASPGSTSESPSGTAPGSTSESPSGTAPG TSPSGESSTAPGSTSESPSGTAPGTSPSGESSTAPGTSPSGESSTAPGSTSSTAESPGPGTSPSG ESSTAPGTSPSGESSTAPGSTAESPGPGTSTPESGSASPGSTSESPSGTA PGSTSESPSGTAPGTSTPESGSASPGSTSSTAESPGPGTSTPESGSASPGSTSESPSGTAPGTSP SGESSTAPGSTSSTAESPGPGTSPSGESSTAPGTSTPESGSASPGSTSSTAESPGPGSTSSTAES PGPGSTSSTAESPGPGTSPSGESSTAPGSTSESPSGTAPGSTSESPSGTAPGT STPESGPXXXGASASGAPSTXXXXSESPSGTAPGSTSESPSGTAPGSTSESPSGTAPGSTSES PSGTAPGSTSESPSGTAPGSTSESPSGTAPGTSTPESGSASPGTSPSGESSTAPGTSPSGESSTA PGSTSSTAESPGPGTSPSGESSTAPGTSTPESGSASPGTSTPESGSASPGSTSESPSGTAPGTSP SGESSTAPGSTSESPSGTAPGTSTPESGSASPGTSTPESGSASPGSTSESPSGTAPGTSTPESGS ASPGSTSSTAESPGPGSTSESPSGTAPGSTSESPSGTAPGTSPSGESSTAPGSTSSTAESPGPGT SPSGESSTAPGTSTPESGSASPGTSPSGESSTAPGTSPSGESSTAPGSTSSTA ESPGPGSTSSTAESPGPGTSPSGESSTAPGSSPSASTGTGPGSSTPSGATGSPGSSTPSGATGSP | 789 |
| AE48-aaT-AE864 | MAEPAGSPTSTEEGTPGSGTASSSPGSSTPSGATGSPGASPGTSSTGSPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDPHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQKGGSPAGSPTSTEEGTSESATPESGPGTSTEPSEGSAPGSPAGSPTSTE EGTSTEPSEGSAPGTSTEPSEGSAPGTSESATPESGPGSEPATSGSETPGSEPATSGSETPGSP AGSPTSTEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPATSGSET PGTSTEPSEGSAPGTSTEPSEGSAPGTSESATPESGPGTSESATPESGPGSPAGSPTSTEEGTS ESATPESGPGSEPATSGSETPGTSESATPESGPGTSTEPSEGSAPGTSTEPSEGSAPGTSTEPS EGSAPGTSTEPSEGSAPGTSTEPSEGSAPGSPAGSPTSTEEGTSTEPSEGSA PGTSESATPESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTSTEEGTSESAT | 790 |

TABLE 40-continued

Exemplary aaT-XTEN comprising aaT and terminal XTEN

| aaT-XTEN Name* | Amino Acid Sequence | SEQ ID NO: |
|---|---|---|
| | PESGPGTSTEPSEGSAPGTSESATPESGPGSEPATSGSETPGTSESATPESGPGSEPATSGSET PGTSESATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPGTSESAT PESGPGTSESATPESGPGSEPATSGSETPGSEPATSGSETPGSPAGSPTSTEEGTSTEPSEGSA PGTSTEPSEGSAPGSEPATSGSETPGTSESATPESGPGTSTEPSEGSAP | |

*Sequence name reflects N- to C-terminus configuration of the aaT and XTEN components

TABLE 41

Exemplary aaT-XTEN comprising aaT, cleavage sequences and XTEN sequences

| aaT-XTEN Name* | Amino Acid Sequence | SEQ ID NO: |
|---|---|---|
| AE912-aaT-Thrombin-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETPGSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGLTPRSLLVGGGG SEPATSGSETPGTSESATPESGPGSEPATSGSETPGSPAGSPTSTEEGTSTEPSEGSAPGSEPA TSGSEPATSGSEPATSGSETPGSEPATSGSETPGTSTEPSEGSAPGTSESATPESGPGSEPATSGS ETPGTSTEPSEGSAP | 791 |
| AE912-aaT-FXIa-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETPGSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGGGKLTRVVGGG GSEPATSGSETPGTSESATPESGPGSEPATSGSETPGSPAGSPTSTEEGTSTEPSEGSAPGSEP ATSGSETPGSEPATSGSETPGTSTEPSEGSAPGTSESATPESGPGSEPATSG SETPGTSTEPSEGSAP | 792 |
| AE912-aaT-Elastase-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSPAGSPTSTEEGTSESATPESGPGSEPATSGSETPGTSESATPES | 793 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| | GPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGSPAGSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGGGLGPVSGVPG GSEPATSGSETPGTSESATPESGPGSEPATSGSETPGSPAGSPTSTEEGTSTEPSEGSAPGSEP ATSGSETPGSEPATSGSETPGSEPATSGSETPGTSTEPSEGSAPGTSESATPESGPGSEPATSG SETPGTSTEPSEGSAP | |
| AE912-aaT-MMP-17-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGAPLGLRLRGGG GSEPATSGSETPGTSESATPESGPGSEPATSGSETPGSPAGSPTSTEEGTSTEPSEGSAPGSEP ATSGSETPGSEPATSGSETPGSEPATSGSETPGTSTEPSEGSAPGTSESATPESGPGSEPATSG SETPGTSTEPSEGSAP | 794 |
| AE912-aaT-Thrombin-AE288 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGSPAGSPTSTEEGSPAGSPTSTEEGSPAGSPTST EEGTSTEPSEGSAPGTSESATPESGPGTSESATPESGPGSPAGSPTSTEEGSPAGSPTST EEGTSTEPSEGSAPGTSESATPESGPGTSESATPESGPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGLTPRSLLVGGGG TSESATPESGPGSEPATSGSETPGTSESATPESGPGSEPATSGSETPGTSESATPESGPGTSTE PSEGSAPGSPAGSPTSTEEGTSESATPESGPGSEPATSGSETPGTSESATPESGPGSPAGSPTS TEEGSPAGSPTSTEEGTSTEPSEGSAPGTSESATPESGPGTSESATPESGPGTSESATPESGPG SEPATSGSETPGSEPATSGSETPGSPAGSPTSTEEGTSTEPSEGSAPGTSTEPSEGSAPGSEPA TSGSETPGTSESATPESGPGTSTEPSEGSAP | 795 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| AE912-aaT-FXIa-AE288 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGGGKLTRVVGGG GTSESATPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPGSEP ATSGSETPGTSESATPESGPGTSTEPSEGSAP | 796 |
| AE912-aaT-Elastase-AE288 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGGGLGPVSGVPG GTSESATPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPGSEP ATSGSETPGTSESATPESGPGTSTEPSEGSAP | 797 |
| AE912-aaT-MMP-17-AE288 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE | 798 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| | AAGAMFLEAIPMSIPPEVKFNKPFVFLMIEQNTKSPLFMGKVVNPTQKGAPLGLRLRGGG GTSESATPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPSPAGSPT STEEGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPGSEP ATSGSETPGTSESATPESGPGTSTEPSEGSAP | |
| AM923-aaT-Thrombin-AE144 | MAEPAGSPTSTEEGASPGTSSTGSPGSSTPSGATGSPGSSTPSGATGSPGTSTEPSEGSAPGS EPATSGSETPGSPAGSPTSTEEGTSSTAESPGPGTSTPESGSASPGSTSESPSGTAPGSTSESP SGTAPGTSTPESGSASPGTSTPESGSASPGSEPATSGSETPGTSESATPESGPGSPAGSPTSTE EGTSTEPSEGSAPGTSESATPESGPGTSTEPSEGSAPGSPAGSPTSTEEGTS TEPSEGSAPGTSTEPSEGSAPGTSESATPESGPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPATSGSETPGSP AGSPTSTEEGSPAGSPTSTEEGTSTEPSEGSAPGASASGAPGTSGTSESATPESGPGSPAGSP TSTEEGSPAGSPTSTEEGTSSTAESPGPGSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGSTSSTAESPGPGTSPSGESSTAPGSEPATSGSETPGSEPATSGSETPGTSTEPSE GSAPGSTSSTAESPGPGTSTPESGSASPGSTSESPSGTAPGSTSEPSEGSAPGSTSTEPSEGSAP GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGEDPQGDAAQKTDTSHHDQDHPTFNKITPNLAEF AFSLYRQLAHQSNSTNIFFSPVSIATAFAMLSLGTKADTHDEILEGLNFNLTEIPEAQIHEGF QELLRTLNQPDSQLQLTTGNLFLSEGLKLVDKFLEDVKKLYHSEAFTVNFGDTEEAKKQI NDYVEKGTQGKIVDLVKELDRDTVFALVNYIFFKGKWERPFEVKDTEEEDFHVDQVTTV KVPMMKRLGMFNIQHCKKLSSWVLLMKYLGNATAIFFLPDEGKLQHLENELTHDIITKFL ENEDRRSASLHLPKLSITGTYDLKSVLGQLGITKVFSNGADLSGVTEEAPLKLSKAVHKAV LTIDEKGTEAAGAMFLEAIPMSIPPEVKFNKPFVFLMIEQNTKSPLFMGKVVNPTQKGLTPR SLLVGGGGSEPATSGSETPGTSESATPESGPGSEPATSGSETPGSPAGSPTSTEEGTSTEPSEG SAPGSEPATSGSETPGSEPATSGSETPGSEPATSGSETPGTSESGSAPGTSESATPESGPG SEPATSGSETPGTSTEPSEGSAP | 799 |
| AM923-aaT-FXIa-AE144 | MAEPAGSPTSTEEGASPGTSSTGSPGSSTPSGATGSPGSSTPSGATGSPGTSTEPSEGSAPGS EPATSGSETPGSPAGSPTSTEEGTSSTAESPGPGTSTPESGSASPGSTSESPSGTAPGSTSESP SGTAPGTSTPESGSASPGTSTPESGSASPGSEPATSGSETPGTSESATPESGPGSPAGSPTSTE EGTSTEPSEGSAPGTSESATPESGPGTSTEPSEGSAPGSPAGSPTSTEEGTS TEPSEGSAPGTSTEPSEGSAPGTSESATPESGPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPATSGSETPGSP AGSPTSTEEGSPAGSPTSTEEGTSTEPSEGSAPGASASGAPGTSGTSESATPESGPGSPAGSP TSTEEGSPAGSPTSTEEGTSSTAESPGPGSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGSTSSTAESPGPGTSPSGESSTAPGSEPATSGSETPGSEPATSGSETPGTSTEPSE GSAPGSTSSTAESPGPGTSTPESGSASPGSTSESPSGTAPGSTSEPSEGSAPGSTSTEPSEGSAP GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGEDPQGDAAQKTDTSHHDQDHPTFNKITPNLAEF AFSLYRQLAHQSNSTNIFFSPVSIATAFAMLSLGTKADTHDEILEGLNFNLTEIPEAQIHEGF QELLRTLNQPDSQLQLTTGNLFLSEGLKLVDKFLEDVKKLYHSEAFTVNFGDTEEAKKQI NDYVEKGTQGKIVDLVKELDRDTVFALVNYIFFKGKWERPFEVKDTEEEDFHVDQVTTV KVPMMKRLGMFNIQHCKKLSSWVLLMKYLGNATAIFFLPDEGKLQHLENELTHDIITKFL ENEDRRSASLHLPKLSITGTYDLKSVLGQLGITKVFSNGADLSGVTEEAPLKLSKAVHKAV LTIDEKGTEAAGAMFLEAIPMSIPPEVKFNKPFVFLMIEQNTKSPLFMGKVVNPTQKGGGK LTRVVGGGGSEPATSGSETPGTSESATPESGPGSEPATSGSETPGSPAGSPTSTEEGTSTEPS EGSAPGSEPATSGSETPGSEPATSGSETPGSEPATSGSETPGTSTEPSEGSAPGTSESATPESG PGSEPATSGSETPGTSTEPSEGSAP | 800 |
| AM923-aaT-Elastase-AE144 | MAEPAGSPTSTEEGASPGTSSTGSPGSSTPSGATGSPGSSTPSGATGSPGTSTEPSEGSAPGS EPATSGSETPGSPAGSPTSTEEGTSSTAESPGPGTSTPESGSASPGSTSESPSGTAPGSTSESP SGTAPGTSTPESGSASPGTSTPESGSASPGSEPATSGSETPGTSESATPESGPGSPAGSPTSTE EGTSTEPSEGSAPGTSESATPESGPGTSTEPSEGSAPGSPAGSPTSTEEGTS TEPSEGSAPGTSTEPSEGSAPGTSESATPESGPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPATSGSETPGSP AGSPTSTEEGSPAGSPTSTEEGTSTEPSEGSAPGASASGAPGTSGTSESATPESGPGSPAGSP TSTEEGSPAGSPTSTEEGTSSTAESPGPGSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGSTSSTAESPGPGTSPSGESSTAPGSEPATSGSETPGSEPATSGSETPGTSTEPSE GSAPGSTSSTAESPGPGTSTPESGSASPGSTSESPSGTAPGSTSEPSEGSAPGSTSTEPSEGSAP GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGEDPQGDAAQKTDTSHHDQDHPTFNKITPNLAEF AFSLYRQLAHQSNSTNIFFSPVSIATAFAMLSLGTKADTHDEILEGLNFNLTEIPEAQIHEGF QELLRTLNQPDSQLQLTTGNLFLSEGLKLVDKFLEDVKKLYHSEAFTVNFGDTEEAKKQI | 801 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| | NDYVEKGTQGKIVDLVKELDRDTVFALVNYIFFKGKWERPFEVKDTEEEDFHVDQVTTV<br>KVPMMKRLGMFNIQHCKKLSSWVLLMKYLGNATAIFFLPDEGKLQHLENELTHDIITKFL<br>ENEDRRSASLHPLKLSITGTYDLKSVLGQLGITKVFSNGADLSGVTEEAPLKLSKAVHKAV<br>LTIDEKGTEAAGAMFLEAIPMSIPPEVKFNKPFVFLMIEQNTKSPLFMGKVVNPTQKGGGL<br>GPVSGVPGGSEPATSGSETPGTSESATPESGPGSEPATSGSETPGSPAGSPTSTEEGTSTEPSE<br>GSAPGSEPATSGSETPGSEPATSGSETPGSEPATSGSETPGTSTEPSEGSAPGTSESATPESGP<br>GSEPATSGSETPGTSTEPSEGSAP | |
| AM923-<br>aaT-MMP-<br>17-AE144 | MAEPAGSPTSTEEGASPGTSSTGSPGSSTPSGATGSPGSSTPSGATGSPGTSTEPSEGSAPGS<br>EPATSGSETPGSPAGSPTSTEEGSTSSTAESPGPGTSTPESGSASPGSTSESPSGTAPGSTSESP<br>SGTAPGTSTPESGSASPGTSTPESGSASPGSEPATSGSETPGTSESATPESGPGSPAGSPTSTE<br>EGTSTEPSEGSAPGTSESATPESGPGTSTEPSEGSAPGTSTEPSEGSAPGSPAGSPTSTEEGTS<br>TEPSEGSAPGTSTEPSEGSAPGTSESATPESGPGTSESATPESGPGTSTEPSEGSAPGTSTEPS<br>EGSAPGTSESATPESGPGTSTEPSEGSAPGSEPATSGSETPGSPAGSPTSTEEGSSTPSGATGS<br>PGTPGSGTASSSPGSSTPSGATGSPGTSTEPSEGSAPGTSTEPSEGSAPGSEPATSGSETPGSP<br>AGSPTSTEEGSPAGSPTSTEEGTSTEPSEGSAPGASASGAPSTGGTSESATPESGPGSPAGSP<br>TSTEEGSPAGSPTSTEEGTSSTAESPGPGSTSESPSGTAPGTSPSGESSTAPGTPGSGTASSSP<br>GSSTPSGATGSPGSSPSASTGTGPGSEPATSGSETPGTSESATPESGPGSEPATSGSETPGSTS<br>TAESPGPGSTSSTAESPGPGTSPSGESSTAPGSEPATSGSETPGSEPATSGSETPGTSTEPSE<br>GSAPGSTSSTAESPGPGTSTPESGSASPGSTSESPSGTAPGTSTEPSEGSAPGTSTEPSEGSAP<br>GTSTEPSEGSAPGSSTPSGATGSPGSSPSASTGTGPGASPGTSSTGSPGSEPATSGSETPGTSE<br>SATPESGPGSPAGSPTSTEEGSSTPSGATGSPGSSPSASTGTGPGASPGTSSTGSPGTSESATP<br>ESGPGTSTEPSEGSAPGTSTEPSEGSAPGEDPQGDAAQKTDTSHHDQDHPTFNKITPNLAEF<br>AFSLYRQLAHQSNSTNIFFSPVSIATAFAMLSLGTKADTHDEILEGLNFNLTEIPEAQIHEGF<br>QELLRTLNQPDSQLQLTTGNGLFLSEGLKLVDKFLEDVKKLYHSEAFTVNFGDTEEAKKQI<br>NDYVEKGTQGKIVDLVKELDRDTVFALVNYIFFKGKWERPFEVKDTEEEDFHVDQVTTV<br>KVPMMKRLGMFNIQHCKKLSSWVLLMKYLGNATAIFFLPDEGKLQHLENELTHDIITKFL<br>ENEDRRSASLHPLKLSITGTYDLKSVLGQLGITKVFSNGADLSGVTEEAPLKLSKAVHKAV<br>LTIDEKGTEAAGAMFLEAIPMSIPPEVKFNKPFVFLMIEQNTKSPLFMGKVVNPTQKGAPL<br>GLRLRGGGGSEPATSGSETPGTSESATPESGPGSEPATSGSETPGSPAGSPTSTEEGTSTEPSE<br>GSAPGSEPATSGSETPGSEPATSGSETPGSEPATSGSETPGTSTEPSEGSAPGTSESATPESGP<br>GSEPATSGSETPGTSTEPSEGSAP | 802 |
| AM923-<br>aaT-<br>Thrombin-<br>AE288 | MAEPAGSPTSTEEGASPGTSSTGSPGSSTPSGATGSPGSSTPSGATGSPGTSTEPSEGSAPGS<br>EPATSGSETPGSPAGSPTSTEEGSTSSTAESPGPGTSTPESGSASPGSTSESPSGTAPGSTSESP<br>SGTAPGTSTPESGSASPGTSTPESGSASPGSEPATSGSETPGTSESATPESGPGSPAGSPTSTE<br>EGTSTEPSEGSAPGTSESATPESGPGTSTEPSEGSAPGTSTEPSEGSAPGSPAGSPTSTEEGTS<br>TEPSEGSAPGTSTEPSEGSAPGTSESATPESGPGTSESATPESGPGTSTEPSEGSAPGTSTEPS<br>EGSAPGTSESATPESGPGTSTEPSEGSAPGSEPATSGSETPGSPAGSPTSTEEGSSTPSGATGS<br>PGTPGSGTASSSPGSSTPSGATGSPGTSTEPSEGSAPGTSTEPSEGSAPGSEPATSGSETPGSP<br>AGSPTSTEEGSPAGSPTSTEEGTSTEPSEGSAPGASASGAPSTGGTSESATPESGPGSPAGSP<br>TSTEEGSPAGSPTSTEEGTSSTAESPGPGSTSESPSGTAPGTSPSGESSTAPGTPGSGTASSSP<br>GSSTPSGATGSPGSSPSASTGTGPGSEPATSGSETPGTSESATPESGPGSEPATSGSETPGSTS<br>TAESPGPGSTSSTAESPGPGTSPSGESSTAPGSEPATSGSETPGSEPATSGSETPGTSTEPSE<br>GSAPGSTSSTAESPGPGTSTPESGSASPGSTSESPSGTAPGTSTEPSEGSAPGTSTEPSEGSAP<br>GTSTEPSEGSAPGSSTPSGATGSPGSSPSASTGTGPGASPGTSSTGSPGSEPATSGSETPGTSE<br>SATPESGPGSPAGSPTSTEEGSSTPSGATGSPGSSPSASTGTGPGASPGTSSTGSPGTSESATP<br>ESGPGTSTEPSEGSAPGTSTEPSEGSAPGEDPQGDAAQKTDTSHHDQDHPTFNKITPNLAEF<br>AFSLYRQLAHQSNSTNIFFSPVSIATAFAMLSLGTKADTHDEILEGLNFNLTEIPEAQIHEGF<br>QELLRTLNQPDSQLQLTTGNGLFLSEGLKLVDKFLEDVKKLYHSEAFTVNFGDTEEAKKQI<br>NDYVEKGTQGKIVDLVKELDRDTVFALVNYIFFKGKWERPFEVKDTEEEDFHVDQVTTV<br>KVPMMKRLGMFNIQHCKKLSSWVLLMKYLGNATAIFFLPDEGKLQHLENELTHDIITKFL<br>ENEDRRSASLHPLKLSITGTYDLKSVLGQLGITKVFSNGADLSGVTEEAPLKLSKAVHKAV<br>LTIDEKGTEAAGAMFLEAIPMSIPPEVKFNKPFVFLMIEQNTKSPLFMGKVVNPTQKGLTPR<br>SLLVGGGGTSESATPESGPGSEPATSGSETPGTSESATPESGPGSEPATSGSETPGTSESATPE<br>SGPGTSTEPSEGSAPGSPAGSPTSTEEGTSESATPESGPGSEPATSGSETPGTSESATPESGPG<br>SPAGSPTSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTSTEPSEG<br>SAPGSEPATSGSETPGTSESATPESGPGTSTEPSEGSAP | 803 |
| AM923-<br>aaT-FXIa-<br>AE288 | MAEPAGSPTSTEEGASPGTSSTGSPGSSTPSGATGSPGSSTPSGATGSPGTSTEPSEGSAPGS<br>EPATSGSETPGSPAGSPTSTEEGSTSSTAESPGPGTSTPESGSASPGSTSESPSGTAPGSTSESP<br>SGTAPGTSTPESGSASPGTSTPESGSASPGSEPATSGSETPGTSESATPESGPGSPAGSPTSTE<br>EGTSTEPSEGSAPGTSESATPESGPGTSTEPSEGSAPGTSTEPSEGSAPGSPAGSPTSTEEGTS<br>TEPSEGSAPGTSTEPSEGSAPGTSESATPESGPGTSESATPESGPGTSTEPSEGSAPGTSTEPS<br>EGSAPGTSESATPESGPGTSTEPSEGSAPGSEPATSGSETPGSPAGSPTSTEEGSSTPSGATGS<br>PGTPGSGTASSSPGSSTPSGATGSPGTSTEPSEGSAPGTSTEPSEGSAPGSEPATSGSETPGSP<br>AGSPTSTEEGSPAGSPTSTEEGTSTEPSEGSAPGASASGAPSTGGTSESATPESGPGSPAGSP<br>TSTEEGSPAGSPTSTEEGTSSTAESPGPGSTSESPSGTAPGTSPSGESSTAPGTPGSGTASSSP<br>GSSTPSGATGSPGSSPSASTGTGPGSEPATSGSETPGTSESATPESGPGSEPATSGSETPGSTS<br>TAESPGPGSTSSTAESPGPGTSPSGESSTAPGSEPATSGSETPGSEPATSGSETPGTSTEPSE<br>GSAPGSTSSTAESPGPGTSTPESGSASPGSTSESPSGTAPGTSTEPSEGSAPGTSTEPSEGSAP<br>GTSTEPSEGSAPGSSTPSGATGSPGSSPSASTGTGPGASPGTSSTGSPGSEPATSGSETPGTSE<br>SATPESGPGSPAGSPTSTEEGSSTPSGATGSPGSSPSASTGTGPGASPGTSSTGSPGTSESATP | 804 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| | ESGPGTSTEPSEGSAPGTSTEPSEGSAPGEDPQGDAAQKTDTSHHDQDHPTFNKITPNLAEF AFSLYRQLAHQSNSTNIFFSPVSIATAFAMLSLGTKADTHDEILEGLNFNLTEIPEAQIHEGF QELLRTLNQPDSQLQLTTGNGLFLSEGLKLVDKFLEDVKKLYHSEAFTVNFGDTEEAKKQI NDYVEKGTQGKIVDLVKELDRDTVFALVNYIFFKGKWERPFEVKDTEEEDFHVDQVTTV KVPMMKRLGMFNIQHCKKLSSWVLLMKYLGNATAIFFLPDEGKLQHLENELTHDIITKFL ENEDRRSASLHLPKLSITGTYDLKSVLGQLGITKVFSNGADLSGVTEEAPLKLSKAVHKAV LTIDEKGTEAAGAMFLEAIPMSIPPEVKFNKPFVFLMIEQNTKSPLFMGKVVNPTQKGGGK LTRVVGGGGTSESATPESGPGSEPATSGSETPGTSESATPESGPGSEPATSGSETPGTSESAT PESGPGTSTEPSEGSAPGSPAGSPTSTEEGTSESATPESGPGSEPATSGSETPGTSESATPESG PGSPAGSPTSTEEGSPAGSPTSTEEGTSTEPSEGSAPGTSESATPESGPGTSESATPESGPGTS ESATPESGPGSEPATSGSETPGSEPATSGSETPGSPAGSPTSTEEGTSTEPSEGSAPGTSTEPS EGSAPGSEPATSGSETPGTSESATPESGPGTSTEPSEGSAP | |
| AM923-aaT-Elastase-AE288 | MAEPAGSPTSTEEGASPGTSSTGSPGSSTPSGATGSPGSSTPSGATGSPGTSTEPSEGSAPGS EPATSGSETPGSPAGSPTSTEEGSTSSTAESPGPGTSTPESGSASPGTSESPSGTAPGSTSESP SGTAPGTSTPESGSASPGTSTPESGSASPGSEPATSGSETPGTSESATPESGPGSPAGSPTSTE EGTSTEPSEGSAPGTSESATPESGPGTSTEPSEGSAPGTSTEPSEGSAPGSPAGSPTSTEEGTS TEPSEGSAPGTSTEPSEGSAPGTSESATPESGPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPATSGSETPGSP AGSPTSTEEGSPAGSPTSTEEGTSTEPSEGSAPGASASGAPSTGGTSESATPESGPGSPAGSP TSTEEGSPAGSPTSTEEGSTSSTAESPGPGSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGSTSSTAESPGPGTSPSGESSTAPGSEPATSGSETPGSEPATSGSETPGTSTEPSE GSAPGSTSSTAESPGPGTSTPESGSASPGSTSESPSGTAPGTSTEPSEGSAPGTSTEPSEGSAP GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGEDPQGDAAQKTDTSHHDQDHPTFNKITPNLAEF AFSLYRQLAHQSNSTNIFFSPVSIATAFAMLSLGTKADTHDEILEGLNFNLTEIPEAQIHEGF QELLRTLNQPDSQLQLTTGNGLFLSEGLKLVDKFLEDVKKLYHSEAFTVNFGDTEEAKKQI NDYVEKGTQGKIVDLVKELDRDTVFALVNYIFFKGKWERPFEVKDTEEEDFHVDQVTTV KVPMMKRLGMFNIQHCKKLSSWVLLMKYLGNATAIFFLPDEGKLQHLENELTHDIITKFL ENEDRRSASLHLPKLSITGTYDLKSVLGQLGITKVFSNGADLSGVTEEAPLKLSKAVHKAV LTIDEKGTEAAGAMFLEAIPMSIPPEVKFNKPFVFLMIEQNTKSPLFMGKVVNPTQKGGGL GPVSGVPGGTSESATPESGPGSEPATSGSETPGTSESATPESGPGSEPATSGSETPGTSESATP ESGPGTSTEPSEGSAPGSPAGSPTSTEEGTSESATPESGPGSEPATSGSETPGTSESATPESGP GSPAGSPTSTEEGSPAGSPTSTEEGTSTEPSEGSAPGTSESATPESGPGTSESATPESGPGTSE SATPESGPGSEPATSGSETPGSEPATSGSETPGSPAGSPTSTEEGTSTEPSEGSAPGTSTEPSE GSAPGSEPATSGSETPGTSESATPESGPGTSTEPSEGSAP | 805 |
| AM923-aaT-MMP-17-AE288 | MAEPAGSPTSTEEGASPGTSSTGSPGSSTPSGATGSPGSSTPSGATGSPGTSTEPSEGSAPGS EPATSGSETPGSPAGSPTSTEEGSTSSTAESPGPGTSTPESGSASPGSTSESPSGTAPGSTSESP SGTAPGTSTPESGSASPGTSTPESGSASPGSEPATSGSETPGTSESATPESGPGSPAGSPTSTE EGTSTEPSEGSAPGTSESATPESGPGTSTEPSEGSAPGTSTEPSEGSAPGSPAGSPTSTEEGTS TEPSEGSAPGTSTEPSEGSAPGTSESATPESGPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPATSGSETPGSP AGSPTSTEEGSPAGSPTSTEEGTSTEPSEGSAPGASASGAPSTGGTSESATPESGPGSPAGSP TSTEEGSPAGSPTSTEEGSTSSTAESPGPGSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGSTSSTAESPGPGTSPSGESSTAPGSEPATSGSETPGSEPATSGSETPGTSTEPSE GSAPGSTSSTAESPGPGTSTPESGSASPGSTSESPSGTAPGTSTEPSEGSAPGTSTEPSEGSAP GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGEDPQGDAAQKTDTSHHDQDHPTFNKITPNLAEF AFSLYRQLAHQSNSTNIFFSPVSIATAFAMLSLGTKADTHDEILEGLNFNLTEIPEAQIHEGF QELLRTLNQPDSQLQLTTGNGLFLSEGLKLVDKFLEDVKKLYHSEAFTVNFGDTEEAKKQI NDYVEKGTQGKIVDLVKELDRDTVFALVNYIFFKGKWERPFEVKDTEEEDFHVDQVTTV KVPMMKRLGMFNIQHCKKLSSWVLLMKYLGNATAIFFLPDEGKLQHLENELTHDIITKFL ENEDRRSASLHLPKLSITGTYDLKSVLGQLGITKVFSNGADLSGVTEEAPLKLSKAVHKAV LTIDEKGTEAAGAMFLEAIPMSIPPEVKFNKPFVFLMIEQNTKSPLFMGKVVNPTQKGGAPL GLRLRGGGGTSESATPESGPGSEPATSGSETPGTSESATPESGPGSEPATSGSETPGTSESAT PESGPGTSTEPSEGSAPGSPAGSPTSTEEGTSESATPESGPGSEPATSGSETPGTSESATPESG PGSPAGSPTSTEEGSPAGSPTSTEEGTSTEPSEGSAPGTSESATPESGPGTSESATPESGPGTS ESATPESGPGSEPATSGSETPGSEPATSGSETPGSPAGSPTSTEEGTSTEPSEGSAPGTSTEPS EGSAPGSEPATSGSETPGTSESATPESGPGTSTEPSEGSAP | 806 |
| AE624-aaT-Thrombin-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSESATPESGPGTSTEPSEGSAPGTSESA TPESGPGTSTEPSEGSAPGSPAGSPTSTEEGTSTEPSEGSAPGSEPATSGSETPGTSESATPES GPGTSTEPSEGSAPGTSTEPSEGSAPGTSTEPSEGSAPGTSTEPSEGSAPGT | 807 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| | STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQKGLTPRSLLVGGGGSEPATSGSETPGTSESATPESGPGSEPATSGSET PGSPAGSPTSTEEGTSTEPSEGSAPGSEPATSGSETPGSEPATSGSETPGSEPATSGSETPGTS TEPSEGSAPGTSESATPESGPGSEPATSGSETPGTSTEPSEGSAP | |
| AE624-aaT-FXIa-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQKGGGKLTRVVGGGGSEPATSGSETPGTSESATPESGPGSEPATSGSE TPGSPAGSPTSTEEGTSTEPSEGSAPGSEPATSGSETPGSEPATSGSETPGSEPATSGSETPGT STEPSEGSAPGTSESATPESGPGSEPATSGSETPGTSTEPSEGSAP | 808 |
| AE624-aaT-Elastase-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQKGGGLGPVSGVPGGSEPATSGSETPGTSESATPESGPGSEPATSGSET PGSPAGSPTSTEEGTSTEPSEGSAPGSEPATSGSETPGSEPATSGSETPGSEPATSGSETPGTS TEPSEGSAPGTSESATPESGPGSEPATSGSETPGTSTEPSEGSAP | 809 |
| AE624-aaT-MMP-17-AE144 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQKGAPLGLRLRGGGGSEPATSGSETPGTSESATPESGPGSEPATSGSET PGSPAGSPTSTEEGTSTEPSEGSAPGSEPATSGSETPGSEPATSGSETPGSEPATSGSETPGTS TEPSEGSAPGTSESATPESGPGSEPATSGSETPGTSTEPSEGSAP | 810 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| AE912-aaT-Thrombin-AE576 | MAEPAGSPTSTEEGTPGSGTASSSPGSSTPSGATGSPGASPGTSSTGSPGSPAGSPTSTEEGT SESATPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGT STEPSEGSAPGTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGT STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPTST EEGTSTEPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETPGTSESA TPESGPGTSTEPSEGSAPGEDPQGDAAQKTDTSHHDQDHPTFNKITPNLAEFAFSLYRQLA HQSNSTNIFFSPVSIATAFAMLSLGTKADTHDEILEGLNFNLTEIPEAQIHEGFQELLRTLNQ PDSQLQLTTGNGLFLSEGLKLVDKFLEDVKKLYHSEAFTVNFGDTEEAKKQINDYVEKGT QGKIVDLVKELDRDTVFALVNYIFFKGKWERPFEVKDTEEEDFHVDQVTTVKVPMMKRL GMFNIQHCKKLSSWVLLMKYLGNATAIFFLPDEGKLQHLENELTHDIITKFLENEDRRSAS LHLPKLSITGTYDLKSVLGQLGITKVFSNGADLSGVTEEAPLKLSKAVHKAVLTIDEKGTE AAGAMFLEAIPMSIPPEVKFNKPFVFLMIEQNTKSPLFMGKVVNPTQKGLTPRSLLVGGGG SPAGSPTSTEEGTSESATPESGPGTSTEPSEGSAPGSPAGSPTSTEEGTSTEPSEGSAPGTSTE PSEGSAPGTSESATPESGPGSEPATSGSETPGSEPATSGSPAGSPTSTEEGTSESATPE SGPGTSTEPSEGSAPGTSTEPSEGSAPGSPAGSPTSTEEGTSTEPSEGSAPGTSTEPSEGSAPG TSESATPESGPGTSTEPSEGSAPGTSESATPESGPGSEPATSGSETPGTSTEPSEGSAPGTSTE PSEGSAPGTSESATPESGPGTSESATPESGPGSPAGSPTSTEEGTSESATPESGPGSEPATSGS ETPGTSESATPESGPGTSTEPSEGSAPGTSTEPSEGSAPGTSTEPSEGSAPGTSTEPSEGSAPG TSTEPSEGSAPGTSESGSAPGSPAGSPTSTEEGTSTEPSEGSAPGTSESATPESGPGSEPA TSGSETPGTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEPSEGSAP | 811 |
| AE48-aaT-FXIa-AE576 | MAEPAGSPTSTEEGTPGSGTASSSPGSSTPSGATGSPGASPGTSSTGSPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQKGGGKLTRVVGGGGSPAGSPTSTEEGTSESATPESGPGTSTEPSEGS APGSPAGSPTSTEEGTSTEPSEGSAPGTSESATPESGPGSPAGSPTSTEEGSPGSEPATSGSETPGS EPATSGSETPGSPAGSPTSTEEGTSESATPESGPGTSTEPSEGSAPGTSTEPSEGSAPGSPAGS PTSTEEGTSTEPSEGSAPGTSTEPSEGSAPGTSESATPESGPGTSTEPSEGSAPGTSESATPES GPGSEPATSGSETPGTSTEPSEGSAPGTSTEPSEGSAPGTSESATPESGPGTSESATPESGPGS PAGSPTSTEEGTSESATPESGPGSEPATSGSETPGTSESATPESGPGSPAGSPTSTEP SEGSAPGTSTEPSEGSAPGTSTEPSEGSAPGTSTEPSEGSAPGTSTEPSEGSAPGSPAGSPTST EEGTSTEPSEGSAPGTSESATPESGPGSEPATSGSETPGTSESATPESGPGSEPATSGSETPGT SESATPESGPGTSTEPSEGSAPGTSESATPESGPGSPAGSPTSTEEGSPAGSPTSTEEGSPAGS PTSTEEGTSESATPESGPGTSTEPSEGSAP | 812 |
| AE48-aaT-Elastase-AE576 | MAEPAGSPTSTEEGTPGSGTASSSPGSSTPSGATGSPGASPGTSSTGSPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLHLPKLSITGTYDLKSVLGQLGITKVFSNGAD LSGVTEEAPLKLSKAVHKAVLTIDEKGTEAAGAMFLEAIPMSIPPEVKFNKPFVFLMIEQNT KSPLFMGKVVNPTQKGGGLGPVSGVPGGSPAGSPTSTEEGTSESATPESGPGTSTEPSEGSA PGSPAGSPTSTEEGTSTEPSEGSAPGTSTEPSEGSAPGTSESATPESGPGSEPATSGSETPGSE PATSGSETPGSPAGSPTSTEEGTSESATPESGPGTSTEPSEGSAPGTSTEPSEGSAPGSPAGSP TSTEEGTSTEPSEGSAPGTSTEPSEGSAPGTSESATPESGPGTSTEPSEGSAPGTSESATPESG PGSEPATSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPGTSTEPS EGSAPGTSTEPSEGSAPGTSTEPSEGSAPGTSTEPSEGSAPGTSTEPSEGSAPGSPAGSPTSTE EGTSTEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPAGSP TSTEEGTSESATPESGPGTSTEPSEGSAP | 813 |
| AE48-aaT-MMP-17-AE576 | MAEPAGSPTSTEEGTPGSGTASSSPGSSTPSGATGSPGASPGTSSTGSPGEDPQGDAAQKTD TSHHDQDHPTFNKITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLKLVDKFLEDVKK LYHSEAFTVNFGDTEEAKKQINDYVEKGTQGKIVDLVKELDRDTVFALVNYIFFKGKWER PFEVKDTEEEDFHVDQVTTVKVPMMKRLGMFNIQHCKKLSSWVLLMKYLGNATAIFFLP DEGKLQHLENELTHDIITKFLENEDRRSASLELPKLSITGTYDLKSVLGQLGITKVFSNGAD LSGVTEEAPLKLSKAVHKAVLTIDEKGTEAAGAMFLEAIPMSIPPEVKFNKPFVFLMIEQNT | 814 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| | KSPLFMGKVVNPTQKGAPLGLRLRGGGGSPAGSPTSTEEGTSESATPESGPGTSTEPSEGSA PGSPAGSPTSTEEGTSTEPSEGSAPGTSTEPSEGSAPGTSESATPESGPGSEPATSGSETPGSE PATSGSETPGSPAGSPTSTEEGTSESATPESGPGTSTEPSEGSAPGTSTEPSEGSAPGSPAGSP TSTEEGTSTEPSEGSAPGTSTEPSEGSAPGTSESATPESGPGTSTEPSEGSAPGTSESATPESG PGSEPATSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPGTSTEPS EGSAPGTSTEPSEGSAPGTSTEPSEGSAPGTSTEPSEGSAPGTSESATPESGPGSPAGSPTSTE EGTSTEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPAGSP TSTEEGTSESATPESGPGTSTEPSEGSAP | |
| AM923-Thrombin-aaT-AE144 | MAEPAGSPTSTEEGASPGTSSTGSPGSSTPSGATGSPGSSTPSGATGSPGTSTEPSEGSAPGS EPATSGSETPGSPAGSPTSTEEGSTSSTAESPGPGTSTPESGSASPGSTSESPSGTAPGSTSESP SGTAPGTSTPESGSASPGTSTPESGSASPGSEPATSGSETPGTSESATPESGPGSPAGSPTSTE EGTSTEPSEGSAPGTSESATPESGPGTSTEPSEGSAPGTSESATPESGPGSPAGSPTSTEEGTS TEPSEGSAPGTSTEPSEGSAPGTSESATPESGPGTSESATPESGPGTSTEPSEGSAPGTSTEPS EGSAPGTSESATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPATSGSETPGSP AGSPTSTEEGSPAGSPTSTEEGTSTEPSEGSAPGASASGAPSTGGTSESATPESGPGSPAGSP TSTEEGSPAGSPTSTEEGSTSSTAESPGPGSTSESPSGTAPGTSPSGESSTAPGTPGSGTASSSP GSSTPSGATGSPGSSPSASTGTGPGSEPATSGSETPGTSESATPESGPGSEPATSGSETPGSTS STAESPGPGSTSSTAESPGPGTSTSPSGESSTAPGSEPATSGSETPGSEPATSGSETPGTSTEPSE GSAPGSTSSTAESPGPGTSTPESGSASPGSTSESPSGTAPGTSTEPSEGSAPGTSTEPSEGSAP GTSTEPSEGSAPGSSTPSGATGSPGSSPSASTGTGPGASPGTSSTGSPGSEPATSGSETPGTSE SATPESGPGSPAGSPTSTEEGSSTPSGATGSPGSSPSASTGTGPGASPGTSSTGSPGTSESATP ESGPGTSTEPSEGSAPGTSTEPSEGSAPGLTPRSLLVGGGEDPQGDAAQKTDTSHHDQDHP TFNKITPNLAEFAFSLYRQLAHQSNSTNIFFSPVSIATAFAMLSLGTKADTHDEILEGLNFNL TEIPEAQIHEGFQELLRTLNQPDSQLQLTTGNGLFLSEGLKLVDKFLEDVKKLYHSEAFTV NFGDTEEAKKQINDYVEKGTQGKIVDLVKELDRDTVFALVNYIFFKGKWERPFEVKDTEE EDFHVDQVTTVKVPMMKRLGMFNIQHCKKLSSWVLLMKYLGNATAIFFLPDEGKLQHLE NELTHDIITKFLENEDRRSASLHLPKLSITGTYDLKSVLGQLGITKVFSNGADLSGVTEEAPL KLSKAVHKAVLTIDEKGTEAAGAMFLEAIPMSIPPEVKFNKPFVFLMIEQNTKSPLFMGKV VNPTQKGGSEPATSGSETPGTSESATPESGPGSEPATSGSETPGSPAGSPTSTEEGTSTEPSE GSAPGSEPATSGSETPGSEPATSGSETPGSEPATSGSETPGTSTEPSEGSAPGTSESATPESGP GSEPATSGSETPGTSTEPSEGSAP | 815 |
| AD576-FXIa-aaT-AE288 | GSSESGSSEGGPGSGGGEPSESGSSGSSESGSSEGGPGSSESGSSEGGPGSSESGSSEGGPGSSE SGSSEGGPGSSESGSSEGGPGESPGGSSGSESGSEGSSGPGESSGSSESGSSEGGPGSSESGSS EGGPGSSESGSSEGGPGSGGGEPSESGSSGESPGGSSGESGPGESSGSSESGSSGGGEPSESGSS GEPSESGSSGSGGGEPSESGSSGSGGGEPSESGSSGSSESGSSEGGPGESPGGSSGSESGESPGGS SGSESGESPGGSSGSESGESPGGSSGSESGSSESGSSEGGPGSGGGEPSESGSS SGSEGSSGPGESSGSSESGSSEGGPGSGGGEPSESGSSGES PGGSSGSESGPGSSGSESGSSEGGPGSGGGEPSESGSSGES ESGSSGSGGGEPSESGSSGESPGGSGSESGSEGSSGPGESSGSSESGSSEGGPGSEGSSGPGES SGGGKLTRVVGGGEDPQGDAAQKTDTSHHDQDHPTFNKITPNLAEFAFSLYRQLAHQSNS TNIFFSPVSIATAFAMLSLGTKADTHDEILEGLNFNLTEIPEAQIHEGFQELLRTLNQPDSQL QLTTGNGLFLSEGLKLVDKFLEDVKKLYHSEAFTVNFGDTEEAKKQINDYVEKGTQGKIV DLVKELDRDTVFALVNYIFFKGKWERPFEVKDTEEEDFHVDQVTTVKVPMMKRLGMFNI QHCKKLSSWVLLMKYLGNATAIFFLPDEGKLQHLENELTHDIITKFLENEDRRSASLHLPK LSITGTYDLKSVLGQLGITKVFSNGADLSGVTEEAPLKLSKAVHKAVLTIDEKGTEAAGA MFLEAIPMSIPPEVKFNKPFVFLMIEQNTKSPLFMGKVVNPTQKGGTSESATPESGPGSEPA TSGSETPGTSESATPESGPGSEPATSGSETPGTSESATPESGPGTSTEPSEGSAPGSPAGSPTS TEEGTSESATPESGPGSEPATSGSETPGTSESATPESGPGSPAGSPTSTEEGSPAGSPTSTEEG TSTEPSEGSAPGTSESATPESGPGTSESATPESGPGSEPATSGSETPGSEPA TSGSETPGSPAGSPTSTEEGTSTEPSEGSAPGTSTEPSEGSAPGSEPATSGSETPGTSESATPE SGPGTSTEPSEGSAP | 816 |
| AE576-Elastase-aaT-AE576 | GSPAGSPTSTEEGTSESATPESGPGTSTEPSEGSAPGSPAGSPTSTEEGTSTEPSEGSAPGTST EPSEGSAPGTSESATPESGPGSEPATSGSETPGSEPATSGSETPGSPAGSPTSTEEGTSESATP ESGPGTSTEPSEGSAPGTSTEPSEGSAPGSPAGSPTSTEEGTSTEPSEGSAPGTSTEPSEGSAP GTSESATPESGPGTSTEPSEGSAPGTSESATPESGPGSEPATSGSETPGTSTEPSEGSAPGTST EPSEGSAPGTSESATPESGPGTSESATPESGPGSPAGSPTSTEEGTSESATPESGPGSEPATSG SETPGTSESATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSTEPSEGSAPGTSESATPESGPGSEP ATSGSETPGTSESATPESGPGSEPATSGSETPGTSESATPESGPGTSTEPSEGSAPGTSESATP ESGPGSPAGSPTSTEEGSPAGSPTSTEEGSPAGSPTSTEEGTSESATPESGPGTSTEPSEGSAP GGGLGPVSGVPGEDPQGDAAQKTDTSHHDQDHPTFNKITPNLAEFAFSLYRQLAHQSNST NIFFSPVSIATAFAMLSLGTKADTHDEILEGLNFNLTEIPEAQIHEGFQELLRTLNQPDSQLQ LTTGNGLFLSEGLKLVDKFLEDVKKLYHSEAFTVNFGDTEEAKKQINDYVEKGTQGKIVD LVKELDRDTVFALVNYIFFKGKWERPFEVKDTEEEDFHVDQVTTVKVPMMKRLGMFNIQ HCKKLSSWVLLMKYLGNATAIFFLPDEGKLQHLENELTHDIITKFLENEDRRSASLHLPKL SITGTYDLKSVLGQLGITKVFSNGADLSGVTEEAPLKLSKAVHKAVLTIDEKGTEAAGAMF LEAIPMSIPPEVKFNKPFVFLMIEQNTKSPLFMGKVVNPTQKGGSPAGSPTSTEEGTSESATP | 817 |

TABLE 41-continued

Exemplary aaT-XTEN comprising aaT, cleavage sequences and XTEN sequences

| aaT-XTEN Name* | Amino Acid Sequence | SEQ ID NO: |
|---|---|---|
| | ESGPGTSTEPSEGSAPGSPAGSPTSTEEGTSTEPSEGSAPGTSTEPSEGSAPGTSESATPESGP<br>GSEPATSGSETPGSEPATSGSETPGSPAGSPTSTEEGTSESATPESGPGTSTEPSEGSAPGTST<br>EPSEGSAPGSPAGSPTSTEEGTSTEPSEGSAPGTSTEPSEGSAPGTSESATPESGPGTSTEPSE<br>GSAPGTSESATPESGPGSEPATSGSETPGTSTEPSEGSAPGTSTEPSEGSAPGTSESATPESGP<br>GTSESATPESGPGSPAGSPTSTEEGTSESATPESGPGSEPATSGSETPGTSESATPESGPGTST<br>EPSEGSAPGTSTEPSEGSAPGTSTEPSEGSAPGTSTEPSEGSAPGTSTEPSEGSAPGTSTEPSE<br>GSAPGSPAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTSTEEGSPA<br>GSPTSTEEGSPAGSPTSTEEGTSESATPESGPGTSTEPSEGSAP | |
| AF576-<br>MMP-17-<br>aaT-AF144 | GSTSSTAESPGPGSTSSTAESPGPGSTSESPSGTAPGSTSSTAESPGPGSTSSTAESPGPGTSTP<br>ESGSASPGSTSESPSGTAPGTSPSGESSTAPGSTSESPSGTAPGSTSESPSGTAPGTSPSGESST<br>APGSTSESPSGTAPGSTSESPSGTAPGTSPSGESSTAPGSTSESPSGTAPGSTSESPSGTAPGST<br>SESPSGTAPGTSTPESGSASPGSTSESPSGTAPGTSTPESGSASPGSTSSTAESPGPGSTSSTAE<br>SPGPGTSTPESGSASPGSTSTPESGSASPGSTSESPSGTAPGTSTPESGSASPGTSTPESGSASPG<br>STSESPSGTAPGSTSESPSGTAPGSTSESPSGTAPGSTSSTAESPGPGTSTPESGSASPGTSTPE<br>SGSASPGSTSESPSGTAPGSTSESPSGTAPGTSTPESGSASPGSTSESPSGTAPGSTSESPSGTA<br>PGTSTPESGSASPGTSPSGESSTAPGSTSSTAESPGPGTSPSGESSTAPGSTSSTAESPGPGTST<br>PESGSASPGSTSESPSGTAPGSTSSTAESPGPGTSTPESGSASPGTSTPESGSASPGAPLGLRL<br>RGGGEDPQGDAAQKTDTSHHDQDHPTFNKITPNLAEFAFSLYRQLAHQSNSTNIFFSPVSI<br>ATAFAMLSLGTKADTHDEILEGLNFNLTEIPEAQIHEGFQELLRTLNQPDSQLQLTTGNGLF<br>LSEGLKLVDKFLEDVKKLYHSEAFTVNFGDTEEAKKQINDYVEKGTQGKIVDLVKELDRD<br>TVFALVNYIFFKGKWERPFEVKDTEEEDFHVDQVTTVKVPMMKRLGMFNIQHCKKLSSW<br>VLLMKYLGNATAIFFLPDEGKLQHLENELTHDIITKFLENEDRRSASLHLPKLSITGTYDLK<br>SVLGQLGITKVFSNGADLSGVTEEAPLKLSKAVHKAVLTIDEKGTEAAGAMFLEAIPMSIP<br>PEVKFNKPFVFLMIEQNTKSPLFMGKVVNPTQKGGTSTPESGSASPGTSPSGESSTAPGTSP<br>SGESSTAPGSTSSTAESPGPGSTSESPSGTAPGSTSSTAESPGPGTSPSGESSTAPGTSTPESGS<br>ASPGSTSSTAESPGPGTSPSGESSTAPGTSPSGESSTAPGTSPSGESSTAP | 818 |

*Sequence name reflects N- to C-terminus configuration of the aaT, XTEN (by family name and length) and cleavage sequence denoted by protease name active on the sequence.

SEQUENCE LISTING (827 sequences)

SEQ ID NO: 1 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 2 - protein, 394 aa, Homo sapiens
EDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 3 - protein, 392 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQATTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDRGHVFRGHTHVYPPRGQVQQTLCLLND

SEQ ID NO: 4 - protein, 394 aa, Artificial Sequence; identical to SEQ ID NO: 2
  Description of Artificial Sequence: Synthetic polypeptide

SEQ ID NO: 5 - protein, 394 aa, Artificial Sequence
  Description of Artificial Sequence: Synthetic polypeptide
EDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPASIPPEVKFNKPFVFLMIEQNTKSPLFMGKVVNPTQK

SEQ ID NO: 6 - protein, 394 aa, Artificial Sequence
  Description of Artificial Sequence: Synthetic polypeptide
EDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPVSIPPEVKFNKPFVFLMIEQNTKSPLFMGKVVNPTQK

SEQ ID NO: 7 - protein, 394 aa, Artificial Sequence
  Description of Artificial Sequence: Synthetic polypeptide
EDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPGSIPPEVKFNKPFVFLMIEQNTKSPLFMGKVVNPTQK

SEQ ID NO: 8 - protein, 394 aa, Artificial Sequence
  Description of Artificial Sequence: Synthetic polypeptide
EDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPFSIPPEVKFNKPFVFLMIEQNTKSPLFMGKVVNPTQK

SEQ ID NO: 9 - protein, 394 aa, Artificial Sequence
  Description of Artificial Sequence: Synthetic polypeptide
EDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPRSIPPEVKFNKPFVFLMIEQNTKSPLFMGKVVNPTQK

SEQ ID NO: 10 - protein, 394 aa, Artificial Sequence
  Description of Artificial Sequence: Synthetic polypeptide
EDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPKSIPPEVKFNKPFVFLMIEQNTKSPLFMGKVVNPTQK

SEQ ID NO: 11 - protein, 389 aa, Mus sp.
EDVQETDTSQKDQSPASHEIATNLGDFAISLYRELVHQSNTSNIFFSPVSIATAFAMLSLGSKGDTHTQILEGLQFNLTQTSEADIHKSFQHLLQTLNRPDSELQLSTGNGLFVNNDLKLVEKFLEEAKNHYQAEVFSVNFAESEEAKKVINDFVEKGTQGKIAEAVKKLDQDTVFALANYILFKGKWKKPFDPENTEEAEFHVDESTTVKVPMMTLSGMLHVHHCSTLSSWVLLMDYAGNATAVFLLPDDGKMQHLEQTLSKELISKFLLNRRRRLAQIHFPRLSISGEYNLKTLMSPLGITRIFNNGADLSGITEENAPLKLSQAVHKAVLTIDETGTEAAAVTVLQMVPMSMPPILRFDHPFLFIIFEEHTQSPIFLGKVVDPTHK

SEQ ID NO: 12 - protein, 392 aa, Bos sp.
GVLQGHAVQETDDTSHQEAACHKIAPNLANFAFSIYHHLAHQSNTSNIFFSPVSIASAFAMLSLGAKGNTHTEILKGLGFNLTELAEAEIHKGFQHLLHTLNQPNHQLQLTTGNGLFINESAKLVDTFLEDVKNLYHSEAFSINFRDAEEAKKKINDYVEKGSHGKIVELVKVLDPNTVFALVNYISFKGKWEKPFEMKHTTERDFHVDEQTTVKVPMMNRLGMFDLHYCDKLASWVLLLDYVGNVTACFILPDLGKLQQLEDKLNNELLAKFLEKKYASSANLHLPKLSISETYDLKSVLGDVGITEVFSDRADLSGITKEQPLKVSKALHKAALTIDEKGTEAVGSTFLEAIPMSLPPDVEFNRPFLCILYDRNTKSPLFVGKVVNPTQA

SEQ ID NO: 13 - protein, 396 aa, Sus sp.
EGLQGHAVQETDVPRHDHEQHQEAACHRIAPNLADFAFSLYRQVARQSNTSNIFLSPVTIARAFAMLSLGTKGATHAEILEGLQFNLTEKAEAEIHEGFQHLLHTLNQPDNQLQLTTGNGLFIDEKAKLVPKFLEDVKNLYHSEAFSINFRDTEEAKKCINDYVEKGSQGKIVDLVDELDKDTVFALVNYIFFKGKWEKPFEVEQTTEEDFHVDEETTVKVPMMNRLGMFDLHHCDKLSSWVLLMDYVATATAFFILPDQGKLHQLEDMLTKEIRAKFLEKRYPSSANLHLPKLTISGTYDLKSLLGNLGITKVFSDEADLSGVTEEQPLKLSKALHRAVLTIDEKGTEATGATILEAIPMSIPPNVKFNKPFLFLIYDTKTKAVLFMGKVMNPTQ

SEQ ID NO: 14 - protein, 394 aa, Papio sp.
EDPQGDAAQKTDTPPHDQNHPTLNKITPSLAEFAFSLYRQLAHQSNSTNIFFSPVSIATAFAMLSLGTKADTHSEILEGLNFNLTEIPEAQVHEGFQELLRTLNKPDSQLQLTTGNGLFLNKSLKVVDKFLEDVKNLYHSEAFSVNFEDTEEAKKQINNYVEKGTQGKVVDLVKELDRDTVFALVNYIFFKGKWERPFEVEATEEEDFHVDQATTVKVPMMRRLGMFNIYHCEKLSSWVLLMKYLGNATAIFFLPDEGKLQHLENELTHDIITKFLENENRRSANLHLPKLAITGTYDLKTVLGHLGITKVFSNGADLSGVTEDAPLKLSKAVHKAVLTIDEKGTEAAGAMFLEAIPMSIPPEVKFNKPFVFLMIEQNTKSPLFIGKVVNPTQK

SEQ ID NO: 15 - protein, 12 aa, Artificial Sequence
  Description of Artificial Sequence: Synthetic peptide
GESPGGSSGSES

SEQ ID NO: 16 - protein, 12 aa, Artificial Sequence
  Description of Artificial Sequence: Synthetic peptide
GSEGSSGPGESS

SEQ ID NO: 17 - protein, 12 aa, Artificial Sequence
  Description of Artificial Sequence: Synthetic peptide
GSSESGSSEGGP

SEQ ID NO: 18 - protein, 12 aa, Artificial Sequence
  Description of Artificial Sequence: Synthetic peptide
GSGGEPSESGSS

SEQ ID NO: 19 - protein, 12 aa, Artificial Sequence
  Description of Artificial Sequence: Synthetic peptide
GSPAGSPTSTEE

SEQ ID NO: 20 - protein, 12 aa, Artificial Sequence
  Description of Artificial Sequence: Synthetic peptide
GSEPATSGSETP

SEQ ID NO: 21 - protein, 12 aa, Artificial Sequence
  Description of Artificial Sequence: Synthetic peptide
GTSESATPESGP

SEQ ID NO: 22 - protein, 12 aa, Artificial Sequence
  Description of Artificial Sequence: Synthetic peptide
GTSTEPSEGSAP

SEQ ID NO: 23 - protein, 12 aa, Artificial Sequence
  Description of Artificial Sequence: Synthetic peptide
GSTSESPSGTAP

SEQ ID NO: 24 - protein, 12 aa, Artificial Sequence
  Description of Artificial Sequence: Synthetic peptide
GTSTPESGSASP

SEQ ID NO: 25 - protein, 12 aa, Artificial Sequence
  Description of Artificial Sequence: Synthetic peptide
GTSPSGESSTAP

SEQ ID NO: 26 - protein, 12 aa, Artificial Sequence
  Description of Artificial Sequence: Synthetic peptide
GSTSSTAESPGP

SEQ ID NO: 27 - protein, 12 aa, Artificial Sequence
  Description of Artificial Sequence: Synthetic peptide
GTPGSGTASSSP

SEQ ID NO: 28 - protein, 12 aa, Artificial Sequence
  Description of Artificial Sequence: Synthetic peptide
GSSTPSGATGSP

SEQ ID NO: 29 - protein, 12 aa, Artificial Sequence
  Description of Artificial Sequence: Synthetic peptide
GSSPSASTGTGP

SEQ ID NO: 30 - protein, 12 aa, Artificial Sequence
  Description of Artificial Sequence: Synthetic peptide
GASPGTSSTGSP

SEQ ID NO: 31 - protein, 12 aa, Artificial Sequence
  Description of Artificial Sequence: Synthetic peptide
GEPAGSPTSTSE

SEQ ID NO: 32 - protein, 12 aa, Artificial Sequence
  Description of Artificial Sequence: Synthetic peptide
GTGEPSSTPASE

SEQ ID NO: 33 - protein, 12 aa, Artificial Sequence
  Description of Artificial Sequence: Synthetic peptide
GSGPSTESAPTE

SEQ ID NO: 34 - protein, 12 aa, Artificial Sequence
  Description of Artificial Sequence: Synthetic peptide
GSETPSGPSETA

SEQ ID NO: 35 - protein, 12 aa, Artificial Sequence
  Description of Artificial Sequence: Synthetic peptide
GPSETSTSEPGA

SEQ ID NO: 36 - protein, 12 aa, Artificial Sequence
  Description of Artificial Sequence: Synthetic peptide
GSPSEPTEGTSA

SEQ ID NO: 37 - protein, 12 aa, Artificial Sequence
  Description of Artificial Sequence: Synthetic peptide
GSGASEPTSTEP

SEQ ID NO: 38 - protein, 12 aa, Artificial Sequence
  Description of Artificial Sequence: Synthetic peptide
GSEPATSGTEPS

SEQ ID NO: 39 - protein, 12 aa, Artificial Sequence
  Description of Artificial Sequence: Synthetic peptide
GTSEPSTSEPGA

SEQ ID NO: 40 - protein, 12 aa, Artificial Sequence
  Description of Artificial Sequence: Synthetic peptide
GTSTEPSEPGSA

SEQ ID NO: 41 - protein, 12 aa, Artificial Sequence
  Description of Artificial Sequence: Synthetic peptide
GSTAGSETSTEA

SEQ ID NO: 42 - protein, 12 aa, Artificial Sequence
  Description of Artificial Sequence: Synthetic peptide
GSETATSGSETA

SEQ ID NO: 43 - protein, 12 aa, Artificial Sequence
  Description of Artificial Sequence: Synthetic peptide
GTSESATSESGA

SEQ ID NO: 44 - protein, 12 aa, Artificial Sequence
  Description of Artificial Sequence: Synthetic peptide
GTSTEASEGSAS

SEQ ID NO: 45 - protein, 42 aa, Artificial Sequence
  Description of Artificial Sequence: Synthetic polypeptide
TEPSEGSAPGSPAGSPTSTEEGTSESATPESGPGSEPATSGS

SEQ ID NO: 46 - protein, 42 aa, Artificial Sequence
  Description of Artificial Sequence: Synthetic polypeptide
PAGSPTSTEEGTSTEPSEGSAPGTSESATPESGPGSEPATSG

SEQ ID NO: 47 - protein, 42 aa, Artificial Sequence
  Description of Artificial Sequence: Synthetic polypeptide
SEPATSGSETPGTSESATPESGPGTSTEPSEGSAPGSPAGSP

SEQ ID NO: 48 - protein, 42 aa, Artificial Sequence
  Description of Artificial Sequence: Synthetic polypeptide
GAPSPSASTGTGPGTPGSGTASSSPGSSTPSGATGSPGPSGP

SEQ ID NO: 49 - protein, 42 aa, Artificial Sequence
  Description of Artificial Sequence: Synthetic polypeptide
GPGTPGSGTASSSPGSSTPSGATGSPGSSPSASTGTGPGASP

SEQ ID NO: 50 - protein, 42 aa, Artificial Sequence
  Description of Artificial Sequence: Synthetic polypeptide
SPSASTGTGPGASPGTSSTGSPGTPGSGTASSSPGSSTPSGA

SEQ ID NO: 51 - protein, 42 aa, Artificial Sequence
  Description of Artificial Sequence: Synthetic polypeptide
SASTGTGPGASPGTSSTGSPGTPGSGTASSSPGSSTPSGATG

SEQ ID NO: 52 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 53 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 54 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 55 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 56 - protein, 144 aa, Artificial Sequence
  Description of Artificial Sequence: Synthetic polypeptide
PGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSS

SEQ ID NO: 57 - protein, 144 aa, Artificial Sequence
  Description of Artificial Sequence: Synthetic polypeptide
SGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASP

SEQ ID NO: 58 - protein, 144 aa, Artificial Sequence
  Description of Artificial Sequence: Synthetic polypeptide
GTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSP

SEQ ID NO: 59 - protein, 144 aa, Artificial Sequence
  Description of Artificial Sequence: Synthetic polypeptide
GTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSP

SEQ ID NO: 60 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 61 - protein, 316 aa, Artificial Sequence
  Description of Artificial Sequence: Synthetic polypeptide
ASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 62 - protein, 288 aa, Artificial Sequence
  Description of Artificial Sequence: Synthetic polypeptide
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 63 - protein, 288 aa, Artificial Sequence
  Description of Artificial Sequence: Synthetic polypeptide
GSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSP

SEQ ID NO: 64 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 65 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 66 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 67 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 68 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 69 - protein, 576 aa, Artificial Sequence
  Description of Artificial Sequence: Synthetic polypeptide
PGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGS

SEQ ID NO: 70 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 71 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 72 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 73 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 74 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 75 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 76 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 77 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 78 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 79 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 80 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 81 - protein, 948 aa, Artificial Sequence
  Description of Artificial Sequence: Synthetic polypeptide
GTSTEPSEGSAPGTSESATPESGPGSEPATSGSETPGTSESATPESGPGTSTEPSEGSAPGSPAGSPTSTEEGTSTEPSEGSAPGSEPATSGSETPGTSESATPESGPGTSESATPESGPGSEPATSGSETPGTSTEPSEGSAPGTSESATPESGPGTSTEPSEGSAPGTSTEPSEGSAPGSEPATSGSETPGTSTEPSEGSAPGSEPATSGSETPGSEPATSGSETPGTSTEPSEGSAPGSEPATSGSETPGSEPATSGSETPGTSTEPSEGSAPGSEPATSGSETPGSPAGSPTSTEEGTSESATPESGPGTSTEPSEGSAPGSEPATSGSETPGTSESATPESGPGSEPATSGSETPGSEPATSGSETPGTSESATPESGPGSPAGSPTSTEEGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSESATPESGPGSPAGSPTSTEEGSPAGSPTSTEEGTSESATPESGPGTSESATPESGPGTSTEPSEGSAPGSPAGSPTSTEEGTSESATPESGPGTSTEPSEGSAPGSEPATSGSETPGSPAGSPTSTEEGTSESATPESGPGTSTEPSEGSAPGSEPATSGSETPGSEPATSGSETPGSEPATSGSETPGSPAGSPTSTEEGTSESATPESGPGSEPATSGSETPGSEPATSGSETPGSPAGSPTSTEEGSPAGSPTSTEEGSPAGSPTSTEEGTSESATPESGPGSEPATSGSETPGTSTEPSEGSAPGTSTEPSEGSAPGSPAGSPTSTEEGSPAGSPTSTEEGSPAGSPTSTEEGTSTEPSEGSAPGTSESATPESGPGTSESATPESGPGTSTEPSEGSAPGTSTEPSEGSAPGTSTEPSEGSAPGTSESATPESGPGTSESATPESGP

SEQ ID NO: 82 - protein, 1024 aa, Artificial Sequence
  Description of Artificial Sequence: Synthetic polypeptide
GSEPATSGSETPGSEPATSGSETPGTSTEPSEGSAPGTSESATPESGPGSPAGSPTSTEEGTSTEPSEGSAPGTSESATPESGPGTSESATPESGPGSEPATSGSETPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSPAGSPTSTEEGTSESATPESGPGSEPATSGSETPGTSTEPSEGSAPGSEPATSGSETPGTSESATPESGPGTSTEPSEGSAPGTSESATPESGPGTSTEPSEGSAPGTSTEPSEGSAPGSEPATSGSETPGSPAGSPTSTEEGTSESATPESGPGTSTEPSEGSAPGSPAGSPTSTEEGTSTEPSEGSAPGTSESATPESGPGTSTEPSEGSAPGSEPATSGSETPGSEPATSGSETPGTSESATPESGPGTSESATPESGPGTSESATPESGPGTSTEPSEGSAPGTSTEPSEGSAPGSPAGSPTSTEEGSPAGSPTSTEEGTSESATPESGPGSPAGSPTSTEEGSPAGSPTSTEEGTSESATPESGPGSEPATSGSETPGTSTEPSEGSAPGSEPATSGSETPGSPAGSPTSTEEGTSESATPESGPGTSESATPESGPGSEPATSGSETPGTSTEPSEGSAPGTSTEPSEGSAPGSPAGSPTSTEEGTSTEPSEGSAPGTSTEPSEGSAPGSEPATSGSETPGSPAGSPTSTEEGTSESATPESGPGTSTEPSEGSAPGSPAGSPTSTEEGTSESATPESGPGTSESATPESGPGTST

SEQ ID NO: 83 - protein, 1024 aa, Artificial Sequence
  Description of Artificial Sequence: Synthetic polypeptide
GSEPATSGSETPGSEPATSGSETPGTSTEPSEGSAPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGTSTEPSEGSAPGSEPATSGSETPGSPAGSPTSTEEGTSTEPSEGSAPGSEPATSGSETPGSPAGSPTSTEEGTSTEPSEGSAPGTSESATPESGPGSPAGSPTSTEEGTSTEPSEGSAPGTSESATPESGPGSEPATSGSETPGTSESATPESGPGSEPATSGSETPGTSTEPSEGSAPGTSTEPSEGSAPGTSTEPSEGSAPGSPAGSPTSTEEGSPAGSPTSTEEGTSESATPESGPGTSTEPSEGSAPGTSTEPSEGSAPGSPAGSPTSTEEGSPAGSPTSTEEGSPAGSPTSTEEGTSESATPESGPGSEPATSGSETPGTSESATPESGPGSPAGSPTSTEEGTSTEPSEGSAPGTSESATPESGPGSEPATSGSETPGSPAGSPTSTEEGTSTEPSEGSAPGTSESATPESGPGTSESATPESGPGSPAGSPTSTEEGTSTEPSEGSAPGSPAGSPTSTEEGSPAGSPTSTEEGTSESATPESGPGSEPATSGSETPGTSTEPSEGSAPGSEPATSGSETPGTSESATPESGPGTSTEPSEGSAPGTSESATPESGPGTSESATPESGPGTSTEPSEGSAPGTSTEPSEGSAPGSEPATSGSETPGTSESATPESGPGTSTEPSEGSAPGSEPATSGSETPGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGSPAGSPTSTEEGSPA

SEQ ID NO: 84 - protein, 1024 aa, Artificial Sequence
  Description of Artificial Sequence: Synthetic polypeptide
GSPAGSPTSTEEGTSTEPSEGSAPGSPAGSPTSTEEGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGSPAGSPTSTEEGTSTEPSEGSAPGSPAGSPTSTEEGTSTEPSEGSAPGSPAGSPTSTEEGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGSPAGSPTSTEEGTSESATPESGPGSEPATSGSETPGSEPATSGSETPGTSESATPESGPGTSESATPESGPGTSTEPSEGSAPGTSTEPSEGSAPGTSESATPESGPGSPAGSPTSTEEGTSTEPSEGSAPGSEPATSGSETPGSPAGSPTSTEEGTSTEPSEGSAPGTSTEPSEGSAPGSPAGSPTSTEEGSPAGSPTSTEEGSPAGSPTSTEEGTSESATPESGPGSEPATSGSETPGTSESATPESGPGTSESATPESGPGTSTEPSEGSAPGTSESATPESGPGSPAGSPTSTEEGTSESATPESGPGTSESATPESGPGTSTEPSEGSAPGSEPATSGSETPGTSTEPSEGSAPGSPAGSPTSTEEGTSESATPESGPGTSTEPSEGSAPGTSTEPSEGSAPGSEPATSGSETPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGSEPATSGSETPGTSTEPSEGSAPGSPAGSPTSTEEGSPAGSPTSTEEGTSESATPESGPGSEPATSGSETPGSPAGSPTSTEEGSPAGSPTSTEEGTSESATPESGPGSEPATSGSETPGTSTEPSEGSAPGTSTEPSEGSAPGSEP

SEQ ID NO: 85 - protein, 1024 aa, Artificial Sequence
  Description of Artificial Sequence: Synthetic polypeptide
GSPAGSPTSTEEGTSTEPSEGSAPGTSESATPESGPGTSESATPESGPGSEPATSGSETPGTSTEPSEGSAPGTSESATPESGPGSPAGSPTSTEEGTSTEPSEGSAPGTSESATPESGPGSPAGSPTSTEEGTSTEPSEGSAPGTSESATPESGPGTSTEPSEGSAPGSEPATSGSETPGSEPATSGSETPGSEPATSGSETPGTSESATPESGPGSPAGSPTSTEEGTSESATPESGPGSEPATSGSETPGTSESATPESGPGTSESATPESGPGSPAGSPTSTEEGTSTEPSEGSAPGTSESATPESGPGTSTEPSEGSAPGTSTEPSEGSAPGTSTEPSEGSAPGSEPATSGSETPGTSTEPSEGSAPGTSESATPESGPGTSESATPESGPGTSTEPSEGSAPGTSESATPESGPGTSESATPESGPGSEPATSGSETPGTSTEPSEGSAPGTSESATPESGPGSPAGSPTSTEEGSPAGSPTSTEEGTSTEPSEGSAPGSEPATSGSETPGSEPATSGSETPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSPAGSPTSTEEGTSESATPESGPGTSTEPSEGSAPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSESATPESGPGTSTEPSEGSAPGSEPATSGSETPGSEPATSGSETPGTSTEPSEGSAPGTSESATPESGPGSPAGSPTSTEEGTSTEPSEGSAPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGTST

SEQ ID NO: 86 - protein, 1024 aa, Artificial Sequence
  Description of Artificial Sequence: Synthetic polypeptide
GSEPATSGSETPGSPAGSPTSTEEGTSTEPSEGSAPGSEPATSGSETPGTSESATPESGPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSEPATSGSETPGTSESATPESGPGSEPATSGSETPGTSTEPSEGSAPGTSTEPSEGSAPGSEPATSGSETPGTSTEPSEGSAPGTSTEPSEGSAPGSPAGSPTSTEEGTSTEPSEGSAPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSPAGSPTSTEEGTSTEPSEGSAPGSPAGSPTSTEEGSPAGSPTSTEEGTSESATPESGPGSEPATSGSETPGSEPATSGSETPGTSTEPSEGSAPGSPAGSPTSTEEGSPAGSPTSTEEGTSESATPESGPGSEPATSGSETPGSEPATSGSETPGTSESATPESGPGSEPATSGSETPGSEPATSGSETPGTSESATPESGPGTSESATPESGPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGTSESATPESGPGSPAGSPTSTEEGTSTEPSEGSAPGSEPATSGSETPGTSTEPSEGSAPGSEPATSGSETPGTSTEPSEGSAPGTSTEPSEGSAPGSPAGSPTSTEEGTSESATPESGPGTSTEPSEGSAPGSEPATSGSETPGTSESATPESGPGTSESATPESGPGTSESATPESGPGTSTEPSEGSAPGSEPATSGSETPGSPAGSPTSTEEGTSESATPESGPGTSTEPSEGSAPGTSTEPSEGSAPGSPAGSPTSTEEGTSESATPESGPGTSTEPSEGSAPGTSTEPSEGSAPGSPAGSPTSTEEGTSESATPESGPGSPA

SEQ ID NO: 87 - protein, 1024 aa, Artificial Sequence
  Description of Artificial Sequence: Synthetic polypeptide
GTSTEPSEGSAPGTSTEPSEGSAPGTSTEPSEGSAPGTSTEPSEGSAPGSPAGSPTSTEEGSPAGSPTSTEEGTSESATPESGPGSEPATSGSETPGTSTEPSEGSAPGTSESATPESGPGTSTEPSEGSAPGTSESATPESGPGTSESATPESGPGSPAGSPTSTEEGTSTEPSEGSAPGSEPATSGSETPGTSTEPSEGSAPGSPAGSPTSTEEGTSTEPSEGSAPGSPAGSPTSTEEGSPAGSPTSTEEGSPAGSPTSTEEGTSESATPESGPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSPAGSPTSTEEGTSESATPESGPGTSESATPESGPGTSTEPSEGSAPGSEPATSGSETPGSEPATSGSETPGTSESATPESGPGSEPATSGSETPGTSTEPSEGSAPGSPAGSPTSTEEGTSTEPSEGSAPGSEPATSGSETPGSEPATSGSETPGSPAGSPTSTEEGTSESATPESGPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGTSESATPESGPGSPAGSPTSTEEGTSTEPSEGSAPGSEPATSGSETPGTSESATPESGPGSEPATSGSETPGTSESATPESGPGSEPATSGSETPGSEPATSGSETPGTSTEPSEGSAPGTSESATPESGPGTSTEPSEGSAPGTSTEPSEGSAPGTSESATPESGPGSPA

SEQ ID NO: 88 - protein, 1024 aa, Artificial Sequence
  Description of Artificial Sequence: Synthetic polypeptide
GSEPATSGSETPGTSTEPSEGSAPGSEPATSGSETPGTSTEPSEGSAPGTSESATPESGPGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGTSESATPESGPGTSTEPSEGSAPGTSESATPESGPGSEPATSGSETPGTSESATPESGPGTSESATPESGPGTSTEPSEGSAPGTSTEPSEGSAPGSEPATSGSETPGSPAGSPTSTEEGTSESATPESGPGSEPATSGSETPGSEPATSGSETPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGSPAGSPTSTEEGSPAGSPTSTEEGTSESATPESGPGSEPATSGSETPGSEPATSGSETPGTSTEPSEGSAPGTSESATPESGPGSPAGSPTSTEEGSPAGSPTSTEEGTSTEPSEGSAPGSPAGSPTSTEEGSPAGSPTSTEEGTSESATPESGPGSEPATSGSETPGTSTEPSEGSAPGTSTEPSEGSAPGSEPATSGSETPGSPAGSPTSTEEGTSESATPESGPGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGSPAGSPTSTEEGTSTEPSEGSAPGSEPATSGSETPGSEPATSGSETPGTSESATPESGPGTSESATPESGPGTSTEPSEGSAPGTSESATPESGPGSEPATSGSETPGTSESATPESGPGTSESATPESGPGTSTEPSEGSAPGTSESATPESGPGSEPATSGSETPGTSTEPSEGSAPGSPAGSPTSTEEGTSESATPESGPGTSTEPSEGSAPGTSTEPSEGSAPGSPAGSPTSTEEGTST

SEQ ID NO: 89 - protein, 1024 aa, Artificial Sequence
  Description of Artificial Sequence: Synthetic polypeptide
GTSESATPESGPGTSTEPSEGSAPGTSESATPESGPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSEPATSGSETPGSEPATSGSETPGTSESATPESGPGTSESATPESGPGSEPATSGSETPGTSESATPESGPGSPAGSPTSTEEGSPAGSPTSTEEGTSTEPSEGSAPGSEPATSGSETPGSPAGSPTSTEEGTSESATPESGPGSPAGSPTSTEEGTSTEPSEGSAPGSEPATSGSETPGSPAGSPTSTEEGTSESATPESGPGSPAGSPTSTEEGSPAGSPTSTEEGTSTEPSEGSAPGSEPATSGSETPGSPAGSPTSTEEGTSESATPESGPGTSTEPSEGSAPGSPAGSPTSTEEGTSESATPESGPGSEPATSGSETPGTSTEPSEGSAPGSPAGSPTSTEEGTSTEPSEGSAPGTSESATPESGPGTSESATPESGPGTSTEPSEGSAPGTSTEPSEGSAPGSEPATSGSETPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSEPATSGSETPGTSESATPESGPGSPAGSPTSTEEGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSPAGSPTSTEEGSPAGSPTSTEEGTSTEPSEGSAPGTSESATPESGPGTSESATPESGPGSPAGSPTSTEEGTSTEPSEGSAPGSPAGSPTSTEEGTSTEPSEGSAPGSPAGSPTSTEEGTSTEPSEGSAPGTSTEPSEGSAPGSEPATSGSETPGSPAGSPTSTEEGTSESATPESGPGSEPATSGSETPGSPAGSPTSTEEGTSESATPESGPGTSE

SEQ ID NO: 90 - protein, 1024 aa, Artificial Sequence
  Description of Artificial Sequence: Synthetic polypeptide
GTSESATPESGPGSPAGSPTSTEEGSPAGSPTSTEEGTSESATPESGPGSEPATSGSETPGTSTEPSEGSAPGTSTEPSEGSAPGTSTEPSEGSAPGSPAGSPTSTEEGTSTEPSEGSAPGTSESATPESGPGTSESATPESGPGSPAGSPTSTEEGSPAGSPTSTEEGSPAGSPTSTEEGTSESATPESGPGSEPATSGSETPGTSESATPESGPGTSTEPSEGSAPGTSESATPESGPGTSTEPSEGSAPGTSTEPSEGSAPGTSESATPESGPGSPAGSPTSTEEGTSESATPESGPGTSTEPSEGSAPGSPAGSPTSTEEGTSESATPESGPGSEPATSGSETPGTSTEPSEGSAPGSEPATSGSETPGSEPATSGSETPGTSESATPESGPGTSESATPESGPGTSTEPSEGSAPGTSESATPESGPGSPAGSPTSTEEGTSTEPSEGSAPGSEPATSGSETPGTSESATPESGPGSEPATSGSETPGTSTEPSEGSAPGTSESATPESGPGSPAGSPTSTEEGSPAGSPTSTEEGSPAGSPTSTEEGTSESATPESGPGSEPATSGSETPGTSESATPESGPGTSESATPESGPGSEPATSGSETPGTSTEPSEGSAPGTSTEPSEGSAPGTSTEPSEGSAPGTSESATPESGPGSEPATSGSETPGTSESATPESGPGSEPATSGSETPGTSTEPSEGSAPGSEPATSGSETPGSPAGSPTSTEEGTSESATPESGPGTSESATPESGPGTSESATPESGPGSPAGSPTSTEEGTSTEPSEGSAPGTSESATPESGPGTSESATPESGPGTSTEPSEGSAPGTSTEPSEGSAPGSPAGSPTSTEEGTSESATPESGPGSEPATSGSETPGTSESATPESGPGTSESATPESGPGTSTEPSEGSAPGSEPATSGSETPGTSESATPESGPGSPAGSPTSTEEGTSTEPSEGSAPGSEPATSGSETPGSPAGSPTSTEEGTSESATPESGPGSPAGSPTSTEEGTSTEPSEGSAPGSEP

SEQ ID NO: 91 - protein, 1024 aa, Artificial Sequence
  Description of Artificial Sequence: Synthetic polypeptide
GSEPATSGSETPGTSTEPSEGSAPGTSESATPESGPGSEPATSGSETPGTSTEPSEGSAPGSPAGSPTSTEEGTSESATPESGPGSPAGSPTSTEEGTSTEPSEGSAPGSEPATSGSETPGTSTEPSEGSAPGTSESATPESGPGSEPATSGSETPGSEPATSGSETPGTSESATPESGPGTSTEPSEGSAPGTSESATPESGPGTSESATPESGPGSPAGSPTSTEEGSPAGSPTSTEEGTSESATPESGPGTSESATPESGPGTSTEPSEGSAPGTSTEPSEGSAPGSPAGSPTSTEEGTSTEPSEGSAPGSEPATSGSETPGSEPATSGSETPGSEPATSGSETPGSEPATSGSETPGTSESATPESGPGTSESATPESGPGTSESATPESGPGTSTEPSEGSAPGTSESATPESGPGTSESATPESGPGTSTEPSEGSAPGSPAGSPTSTEEGTSTEPSEGSAPGSEPATSGSETPGSPAGSPTSTEEGTSESATPESGPGTSTEPSEGSAPGSEPATSGSETPGTSESATPESGPGTSESATPESGPGTSTEPSEGSAPGSEPATSGSETPGSPAGSPTSTEEGTSESATPESGPGTSESATPESGPGTSTEPSEGSAPGSEPATSGSETPGSPAGSPTSTEEGTSESATPESGPGSEPATSGSETPGTSTEPSEGSAPGSEPATSGSETPGSPAGSPTSTEEGTSESATPESGPGTSTEPSEGSAPGSEPATSGSETPGTSESATPESGPGTSESATPESGPGSPAGSPTSTEEGTSTEPSEGSAPGSPAGSPTSTEEGSPAGSPTSTEEGSPAGSPTSTEEGTSESATPESGPGSEPATSGSETPGTSTEPSEGSAPGTSTEPSEGSAPGTSESATPESGPGTSTEPSEGSAPGTSESATPESGPGSEPATSGSETPGTSTEPSEGSAPGTSESATPESGPGSPAGSPTSTEEGSPAGSPTSTEEGSPAGSPTSTEEGTSESATPESGPGSPAGSPTSTEEGTSESATPESGPGSEP

SEQ ID NO: 92 - protein, 1024 aa, Artificial Sequence
  Description of Artificial Sequence: Synthetic polypeptide
GTSTEPSEGSAPGSEPATSGSETPGTSTEPSEGSAPGTSTEPSEGSAPGSEPATSGSETPGSPAGSPTSTEEGSPAGSPTSTEEGTSESATPESGPGSEPATSGSETPGTSTEPSEGSAPGTSTEPSEGSAPGSPAGSPTSTEEGTSESATPESGPGTSESATPESGPGSPAGSPTSTEEGTSTEPSEGSAPGTSESATPESGPGTSTEPSEGSAPGSEPATSGSETPGTSESATPESGPGSEPATSGSETPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSPAGSPTSTEEGTSESATPESGPGTSTEPSEGSAPGSEPATSGSETPGTSESATPESGPGSEPATSGSETPGSPAGSPTSTEEGTSESATPESGPGTSESATPESGPGSEPATSGSETPGTSESATPESGPGTSESATPESGPGTSESATPESGPGTSTEPSEGSAPGTSESATPESGPGSEPATSGSETPGTSTEPSEGSAPGSPAGSPTSTEEGTSTEPSEGSAPGSEPATSGSETPGSPAGSPTSTEEGTSESATPESGPGTSESATPESGPGTSTEPSEGSAPGTSESATPESGPGTSTEPSEGSAPGTSESATPESGPGSEPATSGSETPGTSTEPSEGSAPGTSTEPSEGSAPGSPAGSPTSTEEGSPAGSPTSTEEGTSESATPESGPGTSTEPSEGSAPGTSESATPESGPGSPAGSPTSTEEGSPAGSPTSTEEGSPAGSPTSTEEGTSTEPSEGSAPGSPAGSPTSTEEGSPAGSPTSTEEGTSESATPESGPGSEPATSGSETPGSEPATSGSETPGTSESATPESGPGSEPATSGSETPGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGTSESATPESGPGTSE

SEQ ID NO: 93 - protein, 948 aa, Artificial Sequence
  Description of Artificial Sequence: Synthetic polypeptide
GSSTPSGATGSPGTPGSGTASSSPGASPGTSSTGSPGSSPSASTGTGPGTPGSGTASSSPGTPGSGTASSSPGTPGSGTASSSPGSSPSASTGTGPGTPGSGTASSSPGSSPSASTGTGPGSSTPSGATGSPGSSTPSGATGSPGSSPSASTGTGPGSSTPSGATGSPGASPGTSSTGSPGASPGTSSTGSPGSSPSASTGTGPGSSPSASTGTGPGASPGTSSTGSPGSSPSASTGTGPGASPGTSSTGSPGSSPSASTGTGPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGASPGTSSTGSPGASPGTSSTGSPGSSTPSGATGSPGSSPSASTGTGPGSSPSASTGTGPGTPGSGTASSSPGASPGTSSTGSPGTPGSGTASSSPGSSTPSGATGSPGSSTPSGATGSPGSSPSASTGTGPGSSPSASTGTGPGSSTPSGATGSPGASPGTSSTGSPGTPGSGTASSSPGSSPSASTGTGPGSSTPSGATGSPGASPGTSSTGSPGSSTPSGATGSPGTPGSGTASSSPGSSPSASTGTGPGSSTPSGATGSPGASPGTSSTGSPGASPGTSSTGSPGTPGSGTASSSPGTPGSGTASSSPGSSPSASTGTGPGASPGTSSTGSPGASPGTSSTGSPGTPGSGTASSSPGTPGSGTASSSPGSSTPSGATGSPGSSPSASTGTGPGSSTPSGATGSPGSSPSASTGTGPGSSPSASTGTGPGTPGSGTASSSPGSSTPSGATGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGTPGSGTASSSPGSSTPSGATGSPGSSTPSGATGSP

SEQ ID NO: 94 - protein, 1024 aa, Artificial Sequence
  Description of Artificial Sequence: Synthetic polypeptide
GTPGSGTASSSPGTPGSGTASSSPGSSPSASTGTGPGTPGSGTASSSPGASPGTSSTGSPGTPGSGTASSSPGSSPSASTGTGPGSSTPSGATGSPGASPGTSSTGSPGASPGTSSTGSPGSSPSASTGTGPGSSTPSGATGSPGSSPSASTGTGPGSSPSASTGTGPGTPGSGTASSSPGTPGSGTASSSPGASPGTSSTGSPGSSTPSGATGSPGSSPSASTGTGPGTPGSGTASSSPGASPGTSSTGSPGTPGSGTASSSPGSSPSASTGTGPGSSPSASTGTGPGASPGTSSTGSPGASPGTSSTGSPGSSTPSGATGSPGSSTPSGATGSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGASPGTSSTGSPGSSPSASTGTGPGTPGSGTASSSPGASPGTSSTGSPGASPGTSSTGSPGSSTPSGATGSPGTPGSGTASSSPGSSTPSGATGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGASPGTSSTGSPGTPGSGTASSSPGSSPSASTGTGPGTPGSGTASSSPGSSTPSGATGSPGSSTPSGATGSPGASPGTSSTGSPGSSPSASTGTGPGASPGTSSTGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGTPGSGTASSSPGSSPSASTGTGPGASPGTSSTGSPGSSTPSGATGSPGTPGSGTASSSPGSST

SEQ ID NO: 95 - protein, 1024 aa, Artificial Sequence
  Description of Artificial Sequence: Synthetic polypeptide
GASPGTSSTGSPGSSPSASTGTGPGSSTPSGATGSPGASPGTSSTGSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGASPGTSSTGSPGSSTPSGATGSPGTPGSGTASSSPGSSPSASTGTGPGSSTPSGATGSPGSSPSASTGTGPGSSTPSGATGSPGASPGTSSTGSPGSSPSASTGTGPGTPGSGTASSSPGASPGTSSTGSPGSSTPSGATGSPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGTPGSGTASSSPGSSPSASTGTGPGSSPSASTGTGPGASPGTSSTGSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSPSASTGTGPGTPGSGTASSSPGSSTPSGATGSPGSSTPSGATGSPGASPGTSSTGSPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGASPGTSSTGSPGSSTPSGATGSPGSSPSASTGTGPGSSPSASTGTGPGASPGTSSTGSPGSST

SEQ ID NO: 96 - protein, 1024 aa, Artificial Sequence
  Description of Artificial Sequence: Synthetic polypeptide
GSSPSASTGTGPGTPGSGTASSSPGSSPSASTGTGPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSPSASTGTGPGSSPSASTGTGPGSSTPSGATGSPGASPGTSSTGSPGSSPSASTGTGPGTPGSGTASSSPGTPGSGTASSSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGSSPSASTGTGPGASPGTSSTGSPGSSPSASTGTGPGSSTPSGATGSPGASPGTSSTGSPGASPGTSSTGSPGSSTPSGATGSPGSSPSASTGTGPGASPGTSSTGSPGASPGTSSTGSPGTPGSGTASSSPGSSTPSGATGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGASPGTSSTGSPGTPGSGTASSSPGASPGTSSTGSPGSSTPSGATGSPGASPGTSSTGSPGSSPSASTGTGPGTPGSGTASSSPGTPGSGTASSSPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASP

SEQ ID NO: 97 - protein, 1024 aa, Artificial Sequence
  Description of Artificial Sequence: Synthetic polypeptide
GSSTPSGATGSPGSSPSASTGTGPGTPGSGTASSSPGSSPSASTGTGPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGTPGSGTASSSPGASPGTSSTGSPGSSTPSGATGSPGSSTPSGATGSPGSSPSASTGTGPGTPGSGTASSSPGSSTPSGATGSPGSSTPSGATGSPGSSPSASTGTGPGTPGSGTASSSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGSSTPSGATGSPGSSPSASTGTGPGSSTPSGATGSPGTPGSGTASSSPGSSPSASTGTGPGSSTPSGATGSPGASPGTSSTGSPGASPGTSSTGSPGSSPSASTGTGPGASPGTSSTGSPGSSTPSGATGSPGASPGTSSTGSPGTPGSGTASSSPGTPGSGTASSSPGSSPSASTGTGPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSTPSGATGSPGSSPSASTGTGPGSSPSASTGTGPGASPGTSSTGSPGASPGTSSTGSPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPG

SEQ ID NO: 98 - protein, 1024 aa, Artificial Sequence
  Description of Artificial Sequence: Synthetic polypeptide
GTPGSGTASSSPGSSTPSGATGSPGASPGTSSTGSPGSSTPSGATGSPGTPGSGTASSSPGTPGSGTASSSPGSSTPSGATGSPGSSTPSGATGSPGASPGTSSTGSPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGASPGTSSTGSPGASPGTSSTGSPGTPGSGTASSSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGSSTPSGATGSPGSSPSASTGTGPGSSPSASTGTGPGASPGTSSTGSPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGTPGSGTASSSPGTPGSGTASSSPGSSPSASTGTGPGSSTPSGATGSPGASPGTSSTGSPGASPGTSSTGSPGSSTPSGATGSPGSSPSASTGTGPGASPGTSSTGSPGSSTPSGATGSPGTPGSGTASSSPGASPGTSSTGSPGTPGSGTASSSPGASPGTSSTGSPGSSTPSGATGSPGSSTPSGATGSPGASPGTSSTGSPGSSPSASTGTGPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSTPSGATGSPGSSTPSGATGSPGSSPSASTGTGPGSSTPSGATGSPGTPGSGTASSSPGSSPSASTGTGPGTPGSGTASSSPGSSTPSGATGSPGSSPSASTGTGPGSSPSASTGTGPGTPGSGTASSSPGASP

SEQ ID NO: 99 - protein, 1024 aa, Artificial Sequence
  Description of Artificial Sequence: Synthetic polypeptide
GSSTPSGATGSPGTPGSGTASSSPGTPGSGTASSSPGASPGTSSTGSPGSSTPSGATGSPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSPSASTGTGPGTPGSGTASSSPGASPGTSSTGSPGSSTPSGATGSPGASPGTSSTGSPGTPGSGTASSSPGSSTPSGATGSPGTPGSGTASSSPGSSPSASTGTGPGASPGTSSTGSPGASPGTSSTGSPGTPGSGTASSSPGSSTPSGATGSPGSSTPSGATGSPGSSPSASTGTGPGSSPSASTGTGPGASPGTSSTGSPGTPGSGTASSSPGTPGSGTASSSPGSSPSASTGTGPGASPGTSSTGSPGASPGTSSTGSPGTPGSGTASSSPGSSPSASTGTGPGASPGTSSTGSPGASPGTSSTGSPGSSTPSGATGSPGSSPSASTGTGPGSSPSASTGTGPGTPGSGTASSSPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSPSASTGTGPGSSTPSGATGSPGSSTPSGATGSPGSSPSASTGTGPGTPGSGTASSSPGSSPSASTGTGPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSTPSGATGSPGTPGSGTASSSPGSSPSASTGTGPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGASPGTSSTGSPGASPGTSSTGSPGSSTPSGATGSPGTPG

SEQ ID NO: 100 - protein, 1024 aa, Artificial Sequence
  Description of Artificial Sequence: Synthetic polypeptide
GSSTPSGATGSPGSSTPSGATGSPGTPGSGTASSSPGSSPSASTGTGPGTPGSGTASSSPGASPGTSSTGSPGSSTPSGATGSPGASPGTSSTGSPGTPGSGTASSSPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGASPGTSSTGSPGASPGTSSTGSPGSSTPSGATGSPGASPGTSSTGSPGTPGSGTASSSPGSSTPSGATGSPGSSTPSGATGSPGSSPSASTGTGPGSSPSASTGTGPGSSTPSGATGSPGSSPSASTGTGPGSSPSASTGTGPGASPGTSSTGSPGASPGTSSTGSPGTPGSGTASSSPGSSPSASTGTGPGSSPSASTGTGPGASPGTSSTGSPGSSPSASTGTGPGTPGSGTASSSPGSSPSASTGTGPGSSTPSGATGSPGASPGTSSTGSPGSSTPSGATGSPGTPGSGTASSSPGSSPSASTGTGPGASPGTSSTGSPGSSTPSGATGSPGASPGTSSTGSPGASPGTSSTGSPGTPGSGTASSSPGASPGTSSTGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGSSTPSGATGSPGSSPSASTGTGPGSSTPSGATGSPGSSPSASTGTGPGTPGSGTASSSPGTPGSGTASSSPGSSTPSGATGSPGSSTPSGATGSPGTPGSGTASSSPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGTPGSGTASSSPGTPGSGTASSSPGSSTPSGATGSPGSST

SEQ ID NO: 101 - protein, 1024 aa, Artificial Sequence
  Description of Artificial Sequence: Synthetic polypeptide
GASPGTSSTGSPGSSPSASTGTGPGSSTPSGATGSPGSSPSASTGTGPGTPGSGTASSSPGSSTPSGATGSPGSSTPSGATGSPGSSPSASTGTGPGSSTPSGATGSPGTPGSGTASSSPGSSPSASTGTGPGSSTPSGATGSPGASPGTSSTGSPGSSPSASTGTGPGSSPSASTGTGPGTPGSGTASSSPGASPGTSSTGSPGSSTPSGATGSPGSSPSASTGTGPGASPGTSSTGSPGSSTPSGATGSPGTPGSGTASSSPGSSPSASTGTGPGSSPSASTGTGPGSSPSASTGTGPGTPGSGTASSSPGTPGSGTASSSPGSSTPSGATGSPGTPGSGTASSSPGSSPSASTGTGPGASPGTSSTGSPGASPGTSSTGSPGTPGSGTASSSPGSSPSASTGTGPGASPGTSSTGSPGTPGSGTASSSPGSSTPSGATGSPGSSTPSGATGSPGASPGTSSTGSPGTPGSGTASSSPGSSPSASTGTGPGTPGSGTASSSPGASPGTSSTGSPGSSTPSGATGSPGASPGTSSTGSPGASPGTSSTGSPGTPGSGTASSSPGTPGSGTASSSPGSSPSASTGTGPGSSPSASTGTGPGSSPSASTGTGPGTPGSGTASSSPGASPGTSSTGSPGSSTPSGATGSPGASPGTSSTGSPGSSPSASTGTGPGASPGTSSTGSPGSSPSASTGTGPGASPGTSSTGSPGSSPSASTGTGPGSSPSASTGTGPGTPGSGTASSSPGASPGTSSTGSPGTPGSGTASSSPGTPGSGTASSSPGASPGTSSTGSPGSSTPSGATGSPGSSTPSGATGSPGSSPSASTGTGPGSSTPSGATGSPGTPGSGTASSSPGSSPSASTGTGPGSSTPSGATGSPGSSTPSGATGSPGSSPSASTGTGPGSSPSASTGTGPGASPGTSSTGSPGTPGSGTASSSPGSSPSASTGTGPGSSTPSGATGSPGASPGTSSTGSPGASPGTSSTGSPGSSPSASTGTGPGASPGTSSTGSPGASPGTSSTGSPGTPG

SEQ ID NO: 102 - protein, 1024 aa, Artificial Sequence
  Description of Artificial Sequence: Synthetic polypeptide
GSSTPSGATGSPGSSPSASTGTGPGASPGTSSTGSPGASPGTSSTGSPGTPGSGTASSSPGSSPSASTGTGPGASPGTSSTGSPGSSTPSGATGSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGTPGSGTASSSPGASPGTSSTGSPGSSTPSGATGSPGTPGSGTASSSPGSSPSASTGTGPGSSTPSGATGSPGTPGSGTASSSPGSSPSASTGTGPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGASPGTSSTGSPGASPGTSSTGSPGSSTPSGATGSPGTPGSGTASSSPGSSPSASTGTGPGTPGSGTASSSPGASPGTSSTGSPGTPGSGTASSSPGASPGTSSTGSPGSSTPSGATGSPGSSPSASTGTGPGSSPSASTGTGPGTPGSGTASSSPGASPGTSSTGSPGASPGTSSTGSPGTPGSGTASSSPGASPGTSSTGSPGSSTPSGATGSPGSSTPSGATGSPGSSPSASTGTGPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSTPSGATGSPGTPGSGTASSSPGSSPSASTGTGPGASPGTSSTGSPGSSTPSGATGSPGTPGSGTASSSPGSSTPSGATGSPGSSTPSGATGSPGSSTPSGATGSPGSSPSASTGTGPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGASPGTSSTGSPGSSTPSGATGSPGASP

SEQ ID NO: 103 - protein, 1024 aa, Artificial Sequence
  Description of Artificial Sequence: Synthetic polypeptide
GSSPSASTGTGPGSSPSASTGTGPGSSPSASTGTGPGTPGSGTASSSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGSSTPSGATGSPGSSPSASTGTGPGASPGTSSTGSPGSSPSASTGTGPGASPGTSSTGSPGASPGTSSTGSPGTPGSGTASSSPGTPGSGTASSSPGASPGTSSTGSPGTPGSGTASSSPGTPGSGTASSSPGSSPSASTGTGPGSSTPSGATGSPGASPGTSSTGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSPSASTGTGPGSSTPSGATGSPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGSSTPSGATGSPGTPGSGTASSSPGSSPSASTGTGPGASPGTSSTGSPGSSTPSGATGSPGSSPSASTGTGPGSSTPSGATGSPGASPGTSSTGSPGSSPSASTGTGPGTPGSGTASSSPGSSPSASTGTGPGSSTPSGATGSPGASPGTSSTGSPGSSPSASTGTGPGTPGSGTASSSPGSSTPSGATGSPGSSTPSGATGSPGASPGTSSTGSPGSSPSASTGTGPGSSP

SEQ ID NO: 104 - protein, 1024 aa, Artificial Sequence
  Description of Artificial Sequence: Synthetic polypeptide
GSSPSASTGTGPGTPGSGTASSSPGSSTPSGATGSPGTPGSGTASSSPGSSTPSGATGSPGSSTPSGATGSPGSSPSASTGTGPGSSPSASTGTGPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGSSPSASTGTGPGASPGTSSTGSPGASPGTSSTGSPGASPGTSSTGSPGASPGTSSTGSPGTPGSGTASSSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASPGTSSTGSPGTPGSGTASSSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSPSASTGTGPGSSTPSGATGSPGSSTPSGATGSPGASPGTSSTGSPGSSPSASTGTGPGTPGSGTASSSPGASPGTSSTGSPGSSPSASTGTGPGTPGSGTASSSPGSSPSASTGTGPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSPSASTGTGPGSSPSASTGTGPGASPGTSSTGSPGSSTPSGATGSPGASPGTSSTGSPGTPGSGTASSSPGTPGSGTASSSPGSSPSASTGTGPGASPGTSSTGSPGSSTPSGATGSPGSSPSASTGTGPGSSPSASTGTGPGASPGTSSTGSPGTPGSGTASSSPGSSTPSGATGSPGTPGSGTASSSPGSSPSASTGTGPGSSPSASTGTGPGASP

SEQ ID NO: 105 - protein, 72 aa, Artificial Sequence
  Description of Artificial Sequence: Synthetic polypeptide
SPAGSPTSTEEGSPAGSPTSTEEGTSESATPESGPGTSTEPSEGSAPGTSESATPESGPGSEPATSGSETPG

SEQ ID NO: 106 - protein, 72 aa, Artificial Sequence
  Description of Artificial Sequence: Synthetic polypeptide
TSESATPESGPGTSESATPESGPGSEPATSGSETPGSEPATSGSETPGSPAGSPTSTEEGTSTEPSEGSAPG

SEQ ID NO: 107 - protein, 108 aa, Artificial Sequence
  Description of Artificial Sequence: Synthetic polypeptide
TEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTS

SEQ ID NO: 108 - protein, 108 aa, Artificial Sequence
  Description of Artificial Sequence: Synthetic polypeptide
GSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 109 - protein, 144 aa, Artificial Sequence
  Description of Artificial Sequence: Synthetic polypeptide
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 110 - protein, 144 aa, Artificial Sequence
  Description of Artificial Sequence: Synthetic polypeptide
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 111 - protein, 180 aa, Artificial Sequence
  Description of Artificial Sequence: Synthetic polypeptide
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 112 - protein, 216 aa, Artificial Sequence
  Description of Artificial Sequence: Synthetic polypeptide
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 113 - protein, 252 aa, Artificial Sequence
  Description of Artificial Sequence: Synthetic polypeptide
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 114 - protein, 288 aa, Artificial Sequence
  Description of Artificial Sequence: Synthetic polypeptide
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 115 - protein, 324 aa, Artificial Sequence
  Description of Artificial Sequence: Synthetic polypeptide
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 116 - protein, 360 aa, Artificial Sequence
  Description of Artificial Sequence: Synthetic polypeptide
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 117 - protein, 360 aa, Artificial Sequence
  Description of Artificial Sequence: Synthetic polypeptide
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 118 - protein, 432 aa, Artificial Sequence
  Description of Artificial Sequence: Synthetic polypeptide
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 119 - protein, 468 aa, Artificial Sequence
  Description of Artificial Sequence: Synthetic polypeptide
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 120 - protein, 504 aa, Artificial Sequence
  Description of Artificial Sequence: Synthetic polypeptide
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 121 - protein, 540 aa, Artificial Sequence
  Description of Artificial Sequence: Synthetic polypeptide
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 122 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 123 - protein, 612 aa, Artificial Sequence
  Description of Artificial Sequence: Synthetic polypeptide
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 124 - protein, 648 aa, Artificial Sequence
  Description of Artificial Sequence: Synthetic polypeptide
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 125 - protein, 684 aa, Artificial Sequence
  Description of Artificial Sequence: Synthetic polypeptide
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 126 - protein, 720 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 127 - protein, 756 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 128 - protein, 792 aa, Artificial Sequence
  Description of Artificial Sequence: Synthetic polypeptide
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 129 - protein, 828 aa, Artificial Sequence
  Description of Artificial Sequence: Synthetic polypeptide
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 130 - protein, 72 aa, Artificial Sequence
  Description of Artificial Sequence: Synthetic polypeptide
GPGSSPSASTGTGPGTPGSGTASSSPGSSTPSGATGSPGSSPSASTGTGPGASPGTSSTGSPGTPGSGTASS

SEQ ID NO: 131 - protein, 72 aa, Artificial Sequence
  Description of Artificial Sequence: Synthetic polypeptide
GSSTPSGATGSPGSSTPSGATGSPGSSPSASTGTGPGSSPSASTGTGPGASPGTSSTGSPGTPGSGTASSSP

SEQ ID NO: 132 - protein, 72 aa, Artificial Sequence
  Description of Artificial Sequence: Synthetic polypeptide
SPSASTGTGPGASPGTSSTGSPGSSPSASTGTGPGTPGSGTASSSPGSSTPSGATGSPGSSTPSGATGSPGA

SEQ ID NO: 133 - protein, 108 aa, Artificial Sequence
  Description of Artificial Sequence: Synthetic polypeptide
SASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASP

SEQ ID NO: 134 - protein, 108 aa, Artificial Sequence
  Description of Artificial Sequence: Synthetic polypeptide
PGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSS

SEQ ID NO: 135 - protein, 144 aa, Artificial Sequence; identical to SEQ ID NO: 56
  Description of Artificial Sequence: Synthetic polypeptide

SEQ ID NO: 136 - protein, 144 aa, Artificial Sequence
  Description of Artificial Sequence: Synthetic polypeptide
PSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASP

SEQ ID NO: 137 - protein, 180 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGS

SEQ ID NO: 138 - protein, 216 aa, Artificial Sequence
  Description of Artificial Sequence: Synthetic polypeptide
TGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSG

SEQ ID NO: 139 - protein, 252 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPG

SEQ ID NO: 140 - protein, 288 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGS

SEQ ID NO: 141 - protein, 324 aa, Artificial Sequence
  Description of Artificial Sequence: Synthetic polypeptide
TSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 142 - protein, 360 aa, Artificial Sequence
  Description of Artificial Sequence: Synthetic polypeptide
TSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 143 - protein, 396 aa, Artificial Sequence
  Description of Artificial Sequence: Synthetic polypeptide
GATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGT

SEQ ID NO: 144 - protein, 432 aa, Artificial Sequence
  Description of Artificial Sequence: Synthetic polypeptide
GATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPS

SEQ ID NO: 145 - protein, 468 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 146 - protein, 504 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 147 - protein, 540 aa, Artificial Sequence
  Description of Artificial Sequence: Synthetic polypeptide
TSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 148 - protein, 576 aa, Artificial Sequence
  Description of Artificial Sequence: Synthetic polypeptide
TSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 149 - protein, 612 aa, Artificial Sequence
  Description of Artificial Sequence: Synthetic polypeptide
STGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTS

SEQ ID NO: 150 - protein, 648 aa, Artificial Sequence
  Description of Artificial Sequence: Synthetic polypeptide
GTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 151 - protein, 684 aa, Artificial Sequence
  Description of Artificial Sequence: Synthetic polypeptide
TSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 152 - protein, 720 aa, Artificial Sequence
  Description of Artificial Sequence: Synthetic polypeptide
TSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 153 - protein, 756 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPG

SEQ ID NO: 154 - protein, 792 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 155 - protein, 828 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 156 - protein, 48 aa, Artificial Sequence; identical to SEQ ID NO: 52
  Description of Artificial Sequence: Synthetic polypeptide

SEQ ID NO: 157 - protein, 48 aa, Artificial Sequence; identical to SEQ ID NO: 53
  Description of Artificial Sequence: Synthetic polypeptide

SEQ ID NO: 158 - protein, 4 aa, Artificial Sequence
  Description of Artificial Sequence: Synthetic peptide
GSPG

SEQ ID NO: 159 - protein, 4 aa, Artificial Sequence
  Description of Artificial Sequence: Synthetic peptide
ETET

SEQ ID NO: 160 - protein, 5 aa, Artificial Sequence
  Description of Artificial Sequence: Synthetic peptide
PGSSS

SEQ ID NO: 161 - protein, 5 aa, Artificial Sequence
  Description of Artificial Sequence: Synthetic peptide
GPSGP

SEQ ID NO: 162 - protein, 7 aa, Artificial Sequence
  Description of Artificial Sequence: Synthetic peptide
KLTRAET

SEQ ID NO: 163 - protein, 7 aa, Artificial Sequence
  Description of Artificial Sequence: Synthetic peptide
DFTRVVG

SEQ ID NO: 164 - protein, 8 aa, Artificial Sequence
  Description of Artificial Sequence: Synthetic peptide
TMTRIVGG

SEQ ID NO: 165 - protein, 8 aa, Artificial Sequence
  Description of Artificial Sequence: Synthetic peptide
SPFRSTGG

SEQ ID NO: 166 - protein, 8 aa, Artificial Sequence
  Description of Artificial Sequence: Synthetic peptide
LQVRIVGG

SEQ ID NO: 167 - protein, 8 aa, Artificial Sequence
  Description of Artificial Sequence: Synthetic peptide
PLGRIVGG

SEQ ID NO: 168 - protein, 8 aa, Artificial Sequence
  Description of Artificial Sequence: Synthetic peptide
IEGRTVGG

SEQ ID NO: 169 - protein, 8 aa, Artificial Sequence
  Description of Artificial Sequence: Synthetic peptide
LTPRSLLV

SEQ ID NO: 170 - protein, 8 aa, Artificial Sequence
  Description of Artificial Sequence: Synthetic peptide
LGPVSGVP

SEQ ID NO: 171 - protein, 8 aa, Artificial Sequence
  Description of Artificial Sequence: Synthetic peptide
VAGDSLEE

SEQ ID NO: 172 - protein, 8 aa, Artificial Sequence
  Description of Artificial Sequence: Synthetic peptide
GPAGLGGA

SEQ ID NO: 173 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 174 - protein, 8 aa, Artificial Sequence
  Description of Artificial Sequence: Synthetic peptide
GPAGLRGA

SEQ ID NO: 175 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 176 - protein, 8 aa, Artificial Sequence
  Description of Artificial Sequence: Synthetic peptide
APLGLRLR

SEQ ID NO: 177 - protein, 8 aa, Artificial Sequence
  Description of Artificial Sequence: Synthetic peptide
PALPLVAQ

SEQ ID NO: 178 - protein, 7 aa, Artificial Sequence
  Description of Artificial Sequence: Synthetic peptide
ENLYFQG

SEQ ID NO: 179 - protein, 8 aa, Artificial Sequence
  Description of Artificial Sequence: Synthetic peptide
ENLYFQGS

SEQ ID NO: 180 - protein, 8 aa, Artificial Sequence
  Description of Artificial Sequence: Synthetic peptide
DDDKIVGG

SEQ ID NO: 181 - protein, 8 aa, Artificial Sequence
  Description of Artificial Sequence: Synthetic peptide
DDDKIVGG

SEQ ID NO: 182 - protein, 8 aa, Artificial Sequence
  Description of Artificial Sequence: Synthetic peptide
LEVLFQGP

SEQ ID NO: 183 - protein, 8 aa, Artificial Sequence
  Description of Artificial Sequence: Synthetic peptide
LEVLFQGP

SEQ ID NO: 184 - protein, 8 aa, Artificial Sequence
  Description of Artificial Sequence: Synthetic peptide
LPKTGSES

SEQ ID NO: 185 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 186 - DNA, 144 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttct

SEQ ID NO: 187 - DNA, 144 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctct

SEQ ID NO: 188 - DNA, 432 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 189 - DNA, 432 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 190 - DNA, 864 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 191 - DNA, 1728 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 192 - DNA, 1728 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 193 - DNA, 1875 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 194 - DNA, 2625 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 195 - DNA, 2592 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 196 - DNA, 2625 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 197 - DNA, 2592 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 198 - DNA, 2772 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 199 - DNA, 2739 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 200 - DNA, 3954 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 201 - DNA, 2592 bp, Artificial Sequence
  Description of Artificial Sequence: Synthetic polynucleotide
ggtacttccaccgaaccatccgaaccaggtagcgcaggtacttccaccgaaccatccgaacctggcagcgcaggtagcgaaccggcaacctctggtactgaaccatcaggtagcggcgcatccgagcctacctctactgaaccaggtagcgaaccggctacctccggtactgagccatcaggtagcgaaccggcaacttccggtactgaaccatcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtagcgaaccggctacctctggtactgaaccatcaggtacttctaccgaaccatccgagcctggtagcgcaggtacttctaccgaaccatccgagccaggcagcgcaggtagcgaaccggcaacctctggcactgagccatcaggtagcgaaccagcaacttctggtactgaaccatcaggtactagcgagccatctacttccgaaccaggtgcaggtagcggcgcatccgaacctacttccactgaaccaggtactagcgagccatccacctctgaaccaggtgcaggtagcgaaccggcaacttccggcactgaaccatcaggtagcgaaccggctacctctggtactgaaccatcaggtacttctaccgaaccatccgagcctggtagcgcaggtacttctaccgaaccatccgagccaggcagcgcaggtagcggtgcatccgagccgacctctactgaaccaggtagcgaaccagcaacttctggcactgagccatcaggtagcgaaccagctacctctggtactgaaccatcaggtagcgaaccggctacttccggcactgaaccatcaggtagcgaaccagcaacctccggtactgaaccatcaggtacttccactgaaccatccgaaccgggtagcgcaggtagcgaaccggcaacttccggcactgaaccatcaggtagcggtgcatctgagccgacctctactgaaccaggtacttctactgaaccatctgagccgggcagcgcaggtagcgaacctgcaacctccggcactgagccatcaggtagcggcgcatctgaaccaacctctactgaaccaggtacttccaccgaaccatctgagccaggcagcgcaggtagcggcgcatctgaaccaacctctactgaaccaggtagcgaaccagcaacttctggtactgaaccatcaggtagcggcgcatctgagcctacttccactgaaccaggtagcgaaccggcaacttccggcactgaaccatcaggtagcggtgcatctgagccgacctctactgaaccaggtacttctactgaaccatctgagccgggcagcgcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtacttctactgaaccatccgagccgggtagcgcaggtacttccactgaaccatctgaacctggtagcgcaggtacttccactgaaccatccgaaccaggtagcgcaggtacttctactgaaccatccgagccgggtagcgcaggtacttccactgaaccatctgaacctggtagcgcaggtacttccactgaaccatccgaaccaggtagcgcaggtactagcgaaccatccacctccgaaccaggcgcaggtagcggtgcatctgaaccgacttctactgaaccaggtacttccactgaaccatctgagccaggtagcgcaggtacttccaccgaaccatccgaaccaggtagcgcaggtacttccaccgaaccatccgaacctggcagcgcaggtagcgaaccggcaacctctggtactgaaccatcaggtagcggtgcatccgagccgacctctactgaaccaggtagcgaaccagcaacttctggcactgagccatcaggtagcgaaccagctacctctggtactgaaccatcaggtagcgaaccggcaacctctggcactgagccatcaggtagcgaaccagcaacttctggtactgaaccatcaggtactagcgagccatctacttccgaaccaggtgcaggtagcgaacctgcaacctccggcactgagccatcaggtagcggcgcatctgaaccaacctctactgaaccaggtacttccaccgaaccatctgagccaggcagcgcaggtagcgaacctgcaacctccggcactgagccatcaggtagcggcgcatctgaaccaacctctactgaaccaggtacttccaccgaaccatctgagccaggcagcgca

SEQ ID NO: 202 - DNA, 2592 bp, Artificial Sequence
  Description of Artificial Sequence: Synthetic polynucleotide
ggtagcgaaactgctacttccggctctgagactgcaggtactagtgaatccgcaactagcgaatctggcgcaggtagcactgcaggctctgagacttccactgaagcaggtactagcgagtccgcaaccagcgaatccggcgcaggtagcgaaactgctacctctggctccgagactgcaggtagcgaaactgcaacctctggctctgaaactgcaggtacttccactgaagcaagtgaaggctccgcatcaggtacttccaccgaagcaagcgaaggctccgcatcaggtactagtgagtccgcaactagcgaatccggtgcaggtagcgaaaccgctacctctggttccgaaactgcaggtacttctaccgaggctagcgaaggttctgcatcaggtagcactgctggttccgagacttctactgaagcaggtactagcgaatctgctactagcgaatccggcgcaggtactagcgaatccgctaccagcgaatccggcgcaggtagcgaaactgcaacctctggttccgagactgcaggtactagcgagtccgctactagcgaatctggcgcaggtacttccactgaagctagtgaaggttctgcatcaggtagcgaaactgctacttctggttccgaaactgcaggtagcgaaaccgctacctctggttccgaaactgcaggtacttctaccgaggctagcgaaggttctgcatcaggtagcactgctggttccgagacttctactgaagcaggtactagcgagtccgctactagcgaatctggcgcaggtacttccactgaagctagtgaaggttctgcatcaggtagcgaaactgctacttctggttccgaaactgcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtactagcgaatctgctactagcgaatccggcgcaggtactagcgaatccgctaccagcgaatccggcgcaggtagcgaaactgcaacctctggttccgagactgcaggtagcgaaaccgctacctctggttccgaaactgcaggtacttctaccgaggctagcgaaggttctgcatcaggtagcactgctggttccgagacttctactgaagcaggtagcgaaactgctacttccggctctgagactgcaggtactagtgaatccgcaactagcgaatctggcgcaggtagcactgcaggctctgagacttccactgaagcaggtagcactgctggttccgaaacctctaccgaagcaggtagcactgcaggttctgaaacctccactgaagcaggtacttccactgaggctagtgaaggctctgcatcaggtagcactgctggttccgaaacctctaccgaagcaggtagcactgcaggttctgaaacctccactgaagcaggtacttccactgaggctagtgaaggctctgcatcaggtagcactgcaggttctgagacttccaccgaagcaggtagcgaaactgctacttctggttccgaaactgcaggtacttccactgaagctagtgaaggttccgcatcaggtactagtgagtccgcaaccagcgaatccggcgcaggtagcgaaaccgcaacctccggttctgaaactgcaggtactagcgaatccgcaaccagcgaatctggcgcaggtactagtgagtccgcaaccagcgaatccggcgcaggtagcgaaaccgcaacctccggttctgaaactgcaggtactagcgaatccgcaaccagcgaatctggcgcaggtagcgaaactgctacttccggctctgagactgcaggtacttccaccgaagcaagcgaaggttccgcatcaggtacttccaccgaggctagtgaaggctctgcatcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtagcgaaactgctacttccggctccgagactgcaggtagcgaaactgctacttctggctccgaaactgcaggtacttctactgaggctagtgaaggttccgcatcaggtactagcgagtccgcaaccagcgaatccggcgcaggtagcgaaactgctacctctggctccgagactgcaggtagcgaaactgcaacctctggctctgaaactgcaggtactagcgaatctgctactagcgaatccggcgcaggtactagcgaatccgctaccagcgaatccggcgcaggtagcgaaactgcaacctctggttccgagactgca

SEQ ID NO: 203 - DNA, 37 bp, Artificial Sequence
  Description of Artificial Sequence: Synthetic oligonucleotide
aggtgcaagcgcaagcggcgcgccaagcacgggaggt

SEQ ID NO: 204 - DNA, 37 bp, Artificial Sequence
  Description of Artificial Sequence: Synthetic oligonucleotide
aggtccagaaccaacggggccggccccaagcggaggt

SEQ ID NO: 205 - protein, 6 aa, Artificial Sequence
  Description of Artificial Sequence: Synthetic 6xHis tag
HHHHHH

SEQ ID NO: 206 - DNA, 147 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctcca

SEQ ID NO: 207 - DNA, 147 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctcca

SEQ ID NO: 208 - protein, 12 aa, Artificial Sequence
  Description of Artificial Sequence: Synthetic peptide
GESPGGSSGSES

SEQ ID NO: 209 - protein, 12 aa, Artificial Sequence
  Description of Artificial Sequence: Synthetic peptide
GSEGSSGPGESS

SEQ ID NO: 210 - protein, 12 aa, Artificial Sequence
  Description of Artificial Sequence: Synthetic peptide
GSSESGSSEGGP

SEQ ID NO: 211 - protein, 12 aa, Artificial Sequence
  Description of Artificial Sequence: Synthetic peptide
GSGGEPSESGSS

SEQ ID NO: 212 - DNA, 36 bp, Artificial Sequence
  Description of Artificial Sequence: Synthetic oligonucleotide
aggtgaatctccdggtggytcyagcggttcygartc

SEQ ID NO: 213 - DNA, 36 bp, Artificial Sequence
  Description of Artificial Sequence: Synthetic oligonucleotide
acctgaytcrgaaccgctrgarccacchggagattc

SEQ ID NO: 214 - DNA, 36 bp, Artificial Sequence
  Description of Artificial Sequence: Synthetic oligonucleotide
aggtagcgaaggttcttcyggtccdggygartcytc

SEQ ID NO: 215 - DNA, 36 bp, Artificial Sequence
  Description of Artificial Sequence: Synthetic oligonucleotide
acctgargaytcrcchggaccrgaagaaccttcgct

SEQ ID NO: 216 - DNA, 36 bp, Artificial Sequence
  Description of Artificial Sequence: Synthetic oligonucleotide
aggttcytcygaaagcggttcttcygarggyggtcc

SEQ ID NO: 217 - DNA, 36 bp, Artificial Sequence
  Description of Artificial Sequence: Synthetic oligonucleotide
acctggaccrccytcrgaagaaccgctttcrgarga

SEQ ID NO: 218 - DNA, 36 bp, Artificial Sequence
  Description of Artificial Sequence: Synthetic oligonucleotide
aggttcyggtggygaaccdtcygartctggtagctc

SEQ ID NO: 219 - DNA, 24 bp, Artificial Sequence
  Description of Artificial Sequence: Synthetic oligonucleotide
aggttcgtcttcactcgagggtac

SEQ ID NO: 220 - DNA, 16 bp, Artificial Sequence
  Description of Artificial Sequence: Synthetic oligonucleotide
cctcgagtgaagacga

SEQ ID NO: 221 - protein, 36 aa, Artificial Sequence
  Description of Artificial Sequence: Synthetic polypeptide
GSGGEPSESGSSGESPGGSSGSESGESPGGSSGSES

SEQ ID NO: 222 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 223 - protein, 36 aa, Artificial Sequence
  Description of Artificial Sequence: Synthetic polypeptide
GSEGSSGPGESSGESPGGSSGSESGSSESGSSEGGP

SEQ ID NO: 224 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 225 - protein, 36 aa, Artificial Sequence
  Description of Artificial Sequence: Synthetic polypeptide
GSSESGSSEGGPGSSESGSSEGGPGESPGGSSGSES

SEQ ID NO: 226 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 227 - protein, 36 aa, Artificial Sequence
  Description of Artificial Sequence: Synthetic polypeptide
GSGGEPSESGSSGSSESGSSEGGPGSGGEPSESGSS

SEQ ID NO: 228 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 229 - protein, 36 aa, Artificial Sequence
  Description of Artificial Sequence: Synthetic polypeptide
GSSESGSSEGGPGSEGSSGPGESSGSEGSSGPGESS

SEQ ID NO: 230 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 231 - protein, 36 aa, Artificial Sequence
  Description of Artificial Sequence: Synthetic polypeptide
GSSESGSSEGGPGESPGGSSGSESGSEGSSGPGESS

SEQ ID NO: 232 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 233 - protein, 36 aa, Artificial Sequence
  Description of Artificial Sequence: Synthetic polypeptide
GSGGEPSESGSSGSGGEPSESGSSGSEGSSGPGESS

SEQ ID NO: 234 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 235 - protein, 36 aa, Artificial Sequence
  Description of Artificial Sequence: Synthetic polypeptide
GSSESGSSEGGPGSEGSSGPGESSGESPGGSSGSES

SEQ ID NO: 236 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 237 - protein, 36 aa, Artificial Sequence
  Description of Artificial Sequence: Synthetic polypeptide
GSSESGSSEGGPGSSESGSSEGGPGSSESGSSEGGP

SEQ ID NO: 238 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 239 - protein, 36 aa, Artificial Sequence
  Description of Artificial Sequence: Synthetic polypeptide
GSGGEPSESGSSGSEGSSGPGESSGSSESGSSEGGP

SEQ ID NO: 240 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 241 - protein, 36 aa, Artificial Sequence; identical to SEQ ID NO: 227
  Description of Artificial Sequence: Synthetic polypeptide

SEQ ID NO: 242 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 243 - protein, 36 aa, Artificial Sequence
  Description of Artificial Sequence: Synthetic polypeptide
GSGGEPSESGSSGSSESGSSEGGPGESPGGSSGSES

SEQ ID NO: 244 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 245 - protein, 36 aa, Artificial Sequence
  Description of Artificial Sequence: Synthetic polypeptide
GSGGEPSESGSSGESPGGSSGSESGSEGSSGPGESS

SEQ ID NO: 246 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 247 - protein, 36 aa, Artificial Sequence
  Description of Artificial Sequence: Synthetic polypeptide
GSGGEPSESGSSGESPGGSSGSESGSGGEPSESGSS

SEQ ID NO: 248 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 249 - protein, 36 aa, Artificial Sequence; identical to SEQ ID NO: 237
  Description of Artificial Sequence: Synthetic polypeptide

SEQ ID NO: 250 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 251 - protein, 36 aa, Artificial Sequence
  Description of Artificial Sequence: Synthetic polypeptide
GESPGGSSGSESGSEGSSGPGESSGSEGSSGPGESS

SEQ ID NO: 252 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 253 - protein, 36 aa, Artificial Sequence
  Description of Artificial Sequence: Synthetic polypeptide
GSGGEPSESGSSGSGGEPSESGSSGSSESGSSEGGP

SEQ ID NO: 254 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 255 - protein, 36 aa, Artificial Sequence
  Description of Artificial Sequence: Synthetic polypeptide
GSGGEPSESGSSGSGGEPSESGSSGSGGEPSESGSS

SEQ ID NO: 256 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 257 - protein, 36 aa, Artificial Sequence
  Description of Artificial Sequence: Synthetic polypeptide
GSGGEPSESGSSGSSESGSSEGGPGSEGSSGPGESS

SEQ ID NO: 258 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 259 - protein, 36 aa, Artificial Sequence
  Description of Artificial Sequence: Synthetic polypeptide
GSGGEPSESGSSGSEGSSGPGESSGSGGEPSESGSS

SEQ ID NO: 260 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 261 - protein, 36 aa, Artificial Sequence; identical to SEQ ID NO: 247
  Description of Artificial Sequence: Synthetic polypeptide

SEQ ID NO: 262 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 263 - protein, 36 aa, Artificial Sequence
  Description of Artificial Sequence: Synthetic polypeptide
GSSESGSSEGGPGSGGEPSESGSSGSSESGSSEGGP

SEQ ID NO: 264 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 265 - protein, 36 aa, Artificial Sequence
  Description of Artificial Sequence: Synthetic polypeptide
GSEGSSGPGESSGESPGGSSGSESGSEGSSGPGESS

SEQ ID NO: 266 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 267 - protein, 36 aa, Artificial Sequence; identical to SEQ ID NO: 237
  Description of Artificial Sequence: Synthetic polypeptide

SEQ ID NO: 268 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 269 - protein, 36 aa, Artificial Sequence; identical to SEQ ID NO: 221
  Description of Artificial Sequence: Synthetic polypeptide

SEQ ID NO: 270 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 271 - protein, 36 aa, Artificial Sequence
  Description of Artificial Sequence: Synthetic polypeptide
GSGGEPSESGSSGSEGSSGPGESSGESPGGSSGSES

SEQ ID NO: 272 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 273 - protein, 36 aa, Artificial Sequence
  Description of Artificial Sequence: Synthetic polypeptide
GESPGGSSGSESGESPGGSSGSESGESPGGSSGSES

SEQ ID NO: 274 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 275 - protein, 36 aa, Artificial Sequence
  Description of Artificial Sequence: Synthetic polypeptide
GSEGSSGPGESSGSEGSSGPGESSGSGGEPSESGSS

SEQ ID NO: 276 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 277 - protein, 36 aa, Artificial Sequence; identical to SEQ ID NO: 271
  Description of Artificial Sequence: Synthetic polypeptide

SEQ ID NO: 278 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 279 - protein, 36 aa, Artificial Sequence; identical to SEQ ID NO: 227
  Description of Artificial Sequence: Synthetic polypeptide

SEQ ID NO: 280 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 281 - protein, 36 aa, Artificial Sequence
  Description of Artificial Sequence: Synthetic polypeptide
GSSESGSSEGGPGSGGEPSESGSSGSEGSSGPGESS

SEQ ID NO: 282 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 283 - protein, 36 aa, Artificial Sequence
  Description of Artificial Sequence: Synthetic polypeptide
GSGGEPSESGSSGSEGSSGPGESSGSEGSSGPGESS

SEQ ID NO: 284 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 285 - protein, 36 aa, Artificial Sequence; identical to SEQ ID NO: 227
  Description of Artificial Sequence: Synthetic polypeptide

SEQ ID NO: 286 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 287 - protein, 36 aa, Artificial Sequence; identical to SEQ ID NO: 221
  Description of Artificial Sequence: Synthetic polypeptide

SEQ ID NO: 288 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 289 - protein, 36 aa, Artificial Sequence
  Description of Artificial Sequence: Synthetic polypeptide
GSGGEPSESGSSGSGGEPSESGSSGESPGGSSGSES

SEQ ID NO: 290 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 291 - protein, 36 aa, Artificial Sequence
  Description of Artificial Sequence: Synthetic polypeptide
GSEGSSGPGESSGSSESGSSEGGPGSEGSSGPGESS

SEQ ID NO: 292 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 293 - protein, 36 aa, Artificial Sequence
  Description of Artificial Sequence: Synthetic polypeptide
GSSESGSSEGGPGESPGGSSGSESGESPGGSSGSES

SEQ ID NO: 294 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 295 - protein, 36 aa, Artificial Sequence; identical to SEQ ID NO: 275
  Description of Artificial Sequence: Synthetic polypeptide

SEQ ID NO: 296 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 297 - protein, 12 aa, Artificial Sequence
  Description of Artificial Sequence: Synthetic peptide
GSPAGSPTSTEE

SEQ ID NO: 298 - protein, 12 aa, Artificial Sequence
  Description of Artificial Sequence: Synthetic peptide
GSEPATSGSETP

SEQ ID NO: 299 - protein, 12 aa, Artificial Sequence
  Description of Artificial Sequence: Synthetic peptide
GTSESATPESGP

SEQ ID NO: 300 - protein, 12 aa, Artificial Sequence
  Description of Artificial Sequence: Synthetic peptide
GTSTEPSEGSAP

SEQ ID NO: 301 - DNA, 36 bp, Artificial Sequence
  Description of Artificial Sequence: Synthetic oligonucleotide
aggtagcccdgcwggytctccdacytcyacygarga

SEQ ID NO: 302 - DNA, 36 bp, Artificial Sequence
  Description of Artificial Sequence: Synthetic oligonucleotide
accttcytcrgtrgargthggagarccwgchgggct

SEQ ID NO: 303 - DNA, 36 bp, Artificial Sequence
  Description of Artificial Sequence: Synthetic oligonucleotide
aggtagcgaacckgcwacytcyggytctgaracycc

SEQ ID NO: 304 - DNA, 36 bp, Artificial Sequence
  Description of Artificial Sequence: Synthetic oligonucleotide
acctggrgtytcagarccrgargtwgcmggttcgct

SEQ ID NO: 305 - DNA, 36 bp, Artificial Sequence
  Description of Artificial Sequence: Synthetic oligonucleotide
aggtacytctgaaagcgcwacycckgartcyggycc

SEQ ID NO: 306 - DNA, 36 bp, Artificial Sequence
  Description of Artificial Sequence: Synthetic oligonucleotide
acctggrccrgaytcmggrgtwgcgctttcagargt

SEQ ID NO: 307 - DNA, 36 bp, Artificial Sequence
  Description of Artificial Sequence: Synthetic oligonucleotide
aggtacytctacygaaccktcygarggyagcgcwcc

SEQ ID NO: 308 - DNA, 36 bp, Artificial Sequence
  Description of Artificial Sequence: Synthetic oligonucleotide
acctggwgcgctrccytcrgamggttcrgtagargt

SEQ ID NO: 309 - DNA, 24 bp, Artificial Sequence
  Description of Artificial Sequence: Synthetic oligonucleotide
aggttcgtcttcactcgagggtac

SEQ ID NO: 310 - DNA, 16 bp, Artificial Sequence
  Description of Artificial Sequence: Synthetic oligonucleotide
cctcgagtgaagacga

SEQ ID NO: 311 - protein, 36 aa, Artificial Sequence
  Description of Artificial Sequence: Synthetic polypeptide
GSPAGSPTSTEEGTSESATPESGPGTSTEPSEGSAP

SEQ ID NO: 312 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 313 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 314 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 315 - protein, 36 aa, Artificial Sequence
  Description of Artificial Sequence: Synthetic polypeptide
GTSTEPSEGSAPGTSESATPESGPGTSESATPESGP

SEQ ID NO: 316 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 317 - protein, 36 aa, Artificial Sequence; identical to SEQ ID NO: 315
  Description of Artificial Sequence: Synthetic polypeptide

SEQ ID NO: 318 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 319 - protein, 36 aa, Artificial Sequence
  Description of Artificial Sequence: Synthetic polypeptide
GSEPATSGSETPGTSESATPESGPGSPAGSPTSTEE

SEQ ID NO: 320 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 321 - protein, 36 aa, Artificial Sequence
  Description of Artificial Sequence: Synthetic polypeptide
GTSESATPESGPGSEPATSGSETPGTSTEPSEGSAP

SEQ ID NO: 322 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 323 - protein, 36 aa, Artificial Sequence
  Description of Artificial Sequence: Synthetic polypeptide
GSPAGSPTSTEEGSPAGSPTSTEEGSEPATSGSETP

SEQ ID NO: 324 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 325 - protein, 36 aa, Artificial Sequence; identical to SEQ ID NO: 311
  Description of Artificial Sequence: Synthetic polypeptide

SEQ ID NO: 326 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 327 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 328 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 329 - protein, 36 aa, Artificial Sequence
  Description of Artificial Sequence: Synthetic polypeptide
GTSESATPESGPGTSTEPSEGSAPGTSTEPSEGSAP

SEQ ID NO: 330 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 331 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 332 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 333 - protein, 36 aa, Artificial Sequence
  Description of Artificial Sequence: Synthetic polypeptide
GSEPATSGSETPGSPAGSPTSTEEGTSESATPESGP

SEQ ID NO: 334 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 335 - protein, 36 aa, Artificial Sequence; identical to SEQ ID NO: 315
  Description of Artificial Sequence: Synthetic polypeptide

SEQ ID NO: 336 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 337 - protein, 36 aa, Artificial Sequence
  Description of Artificial Sequence: Synthetic polypeptide
GTSTEPSEGSAPGSEPATSGSETPGSPAGSPTSTEE

SEQ ID NO: 338 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 339 - protein, 36 aa, Artificial Sequence
  Description of Artificial Sequence: Synthetic polypeptide
GSPAGSPTSTEEGTSESATPESGPGSEPATSGSETP

SEQ ID NO: 340 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 341 - protein, 36 aa, Artificial Sequence
  Description of Artificial Sequence: Synthetic polypeptide
GTSESATPESGPGSPAGSPTSTEEGSPAGSPTSTEE

SEQ ID NO: 342 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 343 - protein, 36 aa, Artificial Sequence
  Description of Artificial Sequence: Synthetic polypeptide
GTSTEPSEGSAPGTSESATPESGPGTSTEPSEGSAP

SEQ ID NO: 344 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 345 - protein, 36 aa, Artificial Sequence
  Description of Artificial Sequence: Synthetic polypeptide
GSPAGSPTSTEEGTSTEPSEGSAPGSEPATSGSETP

SEQ ID NO: 346 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 347 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 348 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 349 - protein, 36 aa, Artificial Sequence; identical to SEQ ID NO: 319
  Description of Artificial Sequence: Synthetic polypeptide

SEQ ID NO: 350 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 351 - protein, 36 aa, Artificial Sequence; identical to SEQ ID NO: 329
  Description of Artificial Sequence: Synthetic polypeptide

SEQ ID NO: 352 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 353 - protein, 36 aa, Artificial Sequence; identical to SEQ ID NO: 347
  Description of Artificial Sequence: Synthetic polypeptide

SEQ ID NO: 354 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 355 - protein, 36 aa, Artificial Sequence; identical to SEQ ID NO: 313
  Description of Artificial Sequence: Synthetic polypeptide

SEQ ID NO: 356 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 357 - protein, 36 aa, Artificial Sequence
  Description of Artificial Sequence: Synthetic polypeptide
GSEPATSGSETPGTSESATPESGPGTSTEPSEGSAP

SEQ ID NO: 358 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 359 - protein, 36 aa, Artificial Sequence; identical to SEQ ID NO: 331
  Description of Artificial Sequence: Synthetic polypeptide

SEQ ID NO: 360 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 361 - protein, 36 aa, Artificial Sequence
  Description of Artificial Sequence: Synthetic polypeptide
GSEPATSGSETPGTSESATPESGPGSEPATSGSETP

SEQ ID NO: 362 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 363 - protein, 36 aa, Artificial Sequence; identical to SEQ ID NO: 361
  Description of Artificial Sequence: Synthetic polypeptide

SEQ ID NO: 364 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 365 - protein, 36 aa, Artificial Sequence
  Description of Artificial Sequence: Synthetic polypeptide
GSEPATSGSETPGSEPATSGSETPGTSTEPSEGSAP

SEQ ID NO: 366 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 367 - protein, 36 aa, Artificial Sequence
  Description of Artificial Sequence: Synthetic polypeptide
GTSESATPESGPGSEPATSGSETPGSEPATSGSETP

SEQ ID NO: 368 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 369 - protein, 36 aa, Artificial Sequence
  Description of Artificial Sequence: Synthetic polypeptide
GTSTEPSEGSAPGTSTEPSEGSAPGTSESATPESGP

SEQ ID NO: 370 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 371 - protein, 36 aa, Artificial Sequence
  Description of Artificial Sequence: Synthetic polypeptide
GSEPATSGSETPGTSESATPESGPGTSESATPESGP

SEQ ID NO: 372 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 373 - protein, 36 aa, Artificial Sequence; identical to SEQ ID NO: 365
  Description of Artificial Sequence: Synthetic polypeptide

SEQ ID NO: 374 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 375 - protein, 36 aa, Artificial Sequence
  Description of Artificial Sequence: Synthetic polypeptide
GSEPATSGSETPGTSTEPSEGSAPGSEPATSGSETP

SEQ ID NO: 376 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 377 - protein, 36 aa, Artificial Sequence
  Description of Artificial Sequence: Synthetic polypeptide
GTSTEPSEGSAPGTSTEPSEGSAPGSEPATSGSETP

SEQ ID NO: 378 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 379 - protein, 36 aa, Artificial Sequence; identical to SEQ ID NO: 337
  Description of Artificial Sequence: Synthetic polypeptide

SEQ ID NO: 380 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 381 - protein, 36 aa, Artificial Sequence; identical to SEQ ID NO: 333
  Description of Artificial Sequence: Synthetic polypeptide

SEQ ID NO: 382 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 383 - protein, 36 aa, Artificial Sequence
  Description of Artificial Sequence: Synthetic polypeptide
GTSESATPESGPGSEPATSGSETPGTSESATPESGP

SEQ ID NO: 384 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 385 - protein, 12 aa, Artificial Sequence
  Description of Artificial Sequence: Synthetic peptide
GSTSESPSGTAP

SEQ ID NO: 386 - protein, 12 aa, Artificial Sequence
  Description of Artificial Sequence: Synthetic peptide
GTSTPESGSASP

SEQ ID NO: 387 - protein, 12 aa, Artificial Sequence
  Description of Artificial Sequence: Synthetic peptide
GTSPSGESSTAP

SEQ ID NO: 388 - protein, 12 aa, Artificial Sequence
  Description of Artificial Sequence: Synthetic peptide
GSTSSTAESPGP

SEQ ID NO: 389 - DNA, 36 bp, Artificial Sequence
  Description of Artificial Sequence: Synthetic oligonucleotide
aggttctacyagcgaatcyccktctggyacygcwcc

SEQ ID NO: 390 - DNA, 36 bp, Artificial Sequence
  Description of Artificial Sequence: Synthetic oligonucleotide
acctggwgcrgtrccagamggrgattcgctrgtaga

SEQ ID NO: 391 - DNA, 36 bp, Artificial Sequence
  Description of Artificial Sequence: Synthetic oligonucleotide
aggtacytctacycckgaaagcggytcygcwtctcc

SEQ ID NO: 392 - DNA, 36 bp, Artificial Sequence
  Description of Artificial Sequence: Synthetic oligonucleotide
acctggagawgcrgarccgctttcmggrgtagargt

SEQ ID NO: 393 - DNA, 36 bp, Artificial Sequence
  Description of Artificial Sequence: Synthetic oligonucleotide
aggtacytcycckagcggygaatcttctacygcwcc

SEQ ID NO: 394 - DNA, 36 bp, Artificial Sequence
  Description of Artificial Sequence: Synthetic oligonucleotide
acctggwgcrgtagaagattcrccgctmggrgargt

SEQ ID NO: 395 - DNA, 36 bp, Artificial Sequence
  Description of Artificial Sequence: Synthetic oligonucleotide
aggttcyacyagctctacygcwgaatctcckggycc

SEQ ID NO: 396 - DNA, 36 bp, Artificial Sequence
  Description of Artificial Sequence: Synthetic oligonucleotide
acctggrccmggagattcwgcrgtagagctrgtrga

SEQ ID NO: 397 - DNA, 24 bp, Artificial Sequence
  Description of Artificial Sequence: Synthetic oligonucleotide
aggttcgtcttcactcgagggtac

SEQ ID NO: 398 - DNA, 16 bp, Artificial Sequence
  Description of Artificial Sequence: Synthetic oligonucleotide
cctcgagtgaagacga

SEQ ID NO: 399 - protein, 36 aa, Artificial Sequence
  Description of Artificial Sequence: Synthetic polypeptide
GTSTPESGSASPGTSPSGESSTAPGTSPSGESSTAP

SEQ ID NO: 400 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 401 - protein, 36 aa, Artificial Sequence
  Description of Artificial Sequence: Synthetic polypeptide
GTSPSGESSTAPGSTSSTAESPGPGTSPSGESSTAP

SEQ ID NO: 402 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 403 - protein, 36 aa, Artificial Sequence
  Description of Artificial Sequence: Synthetic polypeptide
GSTSSTAESPGPGTSPSGESSTAPGTSTPESGSASP

SEQ ID NO: 404 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 405 - protein, 36 aa, Artificial Sequence
  Description of Artificial Sequence: Synthetic polypeptide
GSTSSTAESPGPGSTSSTAESPGPGTSPSGESSTAP

SEQ ID NO: 406 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 407 - protein, 36 aa, Artificial Sequence; identical to SEQ ID NO: 403
  Description of Artificial Sequence: Synthetic polypeptide

SEQ ID NO: 408 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 409 - protein, 36 aa, Artificial Sequence
  Description of Artificial Sequence: Synthetic polypeptide
GSTSSTAESPGPGTSTPESGSASPGSTSESPSGTAP

SEQ ID NO: 410 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 411 - protein, 36 aa, Artificial Sequence
  Description of Artificial Sequence: Synthetic polypeptide
GSTSSTAESPGPGTSTPESGSASPGTSTPESGSASP

SEQ ID NO: 412 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 413 - protein, 36 aa, Artificial Sequence
  Description of Artificial Sequence: Synthetic polypeptide
GSTSESPSGTAPGTSPSGESSTAPGSTSESPSGTAP

SEQ ID NO: 414 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 415 - protein, 36 aa, Artificial Sequence; identical to SEQ ID NO: 405
  Description of Artificial Sequence: Synthetic polypeptide

SEQ ID NO: 416 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 417 - protein, 36 aa, Artificial Sequence; identical to SEQ ID NO: 409
  Description of Artificial Sequence: Synthetic polypeptide

SEQ ID NO: 418 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 419 - protein, 36 aa, Artificial Sequence; identical to SEQ ID NO: 405
  Description of Artificial Sequence: Synthetic polypeptide

SEQ ID NO: 420 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 421 - protein, 36 aa, Artificial Sequence
  Description of Artificial Sequence: Synthetic polypeptide
GSTSSTAESPGPGSTSESPSGTAPGSTSSTAESPGP

SEQ ID NO: 422 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 423 - protein, 36 aa, Artificial Sequence
  Description of Artificial Sequence: Synthetic polypeptide
GSTSSTAESPGPGSTSSTAESPGPGSTSSTAESPGP

SEQ ID NO: 424 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 425 - protein, 36 aa, Artificial Sequence
  Description of Artificial Sequence: Synthetic polypeptide
GSTSESPSGTAPGSTSSTAESPGPGSTSSTAESPGP

SEQ ID NO: 426 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 427 - protein, 36 aa, Artificial Sequence
  Description of Artificial Sequence: Synthetic polypeptide
GSTSESPSGTAPGSTSESPSGTAPGSTSESPSGTAP

SEQ ID NO: 428 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 429 - protein, 36 aa, Artificial Sequence; identical to SEQ ID NO: 423
  Description of Artificial Sequence: Synthetic polypeptide

SEQ ID NO: 430 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 431 - protein, 36 aa, Artificial Sequence; identical to SEQ ID NO: 405
  Description of Artificial Sequence: Synthetic polypeptide

SEQ ID NO: 432 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 433 - protein, 36 aa, Artificial Sequence
  Description of Artificial Sequence: Synthetic polypeptide
GSSPSASTGTGPGSSTPSGATGSPGSSTPSGATGSP

SEQ ID NO: 434 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 435 - protein, 36 aa, Artificial Sequence
  Description of Artificial Sequence: Synthetic polypeptide
GTSPSGESSTAPGTSTPESGSASPGSTSSTAESPGP

SEQ ID NO: 436 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 437 - protein, 36 aa, Artificial Sequence
  Description of Artificial Sequence: Synthetic polypeptide
GSTSSTAESPGPGSTSSTAESPGPGTSTPESGSASP

SEQ ID NO: 438 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 439 - protein, 36 aa, Artificial Sequence
  Description of Artificial Sequence: Synthetic polypeptide
GTSPSGESSTAPGSTSSTAESPGPGTSTPESGSASP

SEQ ID NO: 440 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 441 - protein, 36 aa, Artificial Sequence; identical to SEQ ID NO: 425
  Description of Artificial Sequence: Synthetic polypeptide

SEQ ID NO: 442 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 443 - protein, 36 aa, Artificial Sequence; identical to SEQ ID NO: 421
  Description of Artificial Sequence: Synthetic polypeptide

SEQ ID NO: 444 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 445 - protein, 36 aa, Artificial Sequence; identical to SEQ ID NO: 403
  Description of Artificial Sequence: Synthetic polypeptide

SEQ ID NO: 446 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 447 - protein, 36 aa, Artificial Sequence
  Description of Artificial Sequence: Synthetic polypeptide
GSTSESPSGTAPGSTSESPSGTAPGTSPSGESSTAP

SEQ ID NO: 448 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 449 - protein, 36 aa, Artificial Sequence
  Description of Artificial Sequence: Synthetic polypeptide
GSTSESPSGTAPGSTSESPSGTAPGTSTPESGSASP

SEQ ID NO: 450 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 451 - protein, 36 aa, Artificial Sequence
  Description of Artificial Sequence: Synthetic polypeptide
GTSTPESGSASPGSTSSTAESPGPGSTSSTAESPGP

SEQ ID NO: 452 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 453 - protein, 36 aa, Artificial Sequence; identical to SEQ ID NO: 447
  Description of Artificial Sequence: Synthetic polypeptide

SEQ ID NO: 454 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 455 - protein, 36 aa, Artificial Sequence
  Description of Artificial Sequence: Synthetic polypeptide
GSTSSTAESPGPGSTSSTAESPGPGSTSESPSGTAP

SEQ ID NO: 456 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 457 - protein, 36 aa, Artificial Sequence; identical to SEQ ID NO: 437
  Description of Artificial Sequence: Synthetic polypeptide

SEQ ID NO: 458 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 459 - protein, 36 aa, Artificial Sequence; identical to SEQ ID NO: 455
  Description of Artificial Sequence: Synthetic polypeptide

SEQ ID NO: 460 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 461 - protein, 36 aa, Artificial Sequence
  Description of Artificial Sequence: Synthetic polypeptide
GTSPSGESSTAPGSTSESPSGTAPGSTSSTAESPGP

SEQ ID NO: 462 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 463 - protein, 36 aa, Artificial Sequence
  Description of Artificial Sequence: Synthetic polypeptide
GSTSESPSGTAPGTSPSGESSTAPGSTSSTAESPGP

SEQ ID NO: 464 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 465 - protein, 36 aa, Artificial Sequence
  Description of Artificial Sequence: Synthetic polypeptide
GSTSSTAESPGPGSTSESPSGTAPGTSPSGESSTAP

SEQ ID NO: 466 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 467 - protein, 36 aa, Artificial Sequence; identical to SEQ ID NO: 449
  Description of Artificial Sequence: Synthetic polypeptide

SEQ ID NO: 468 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 469 - protein, 36 aa, Artificial Sequence
  Description of Artificial Sequence: Synthetic polypeptide
GTSTPESGSASPGSTSESPSGTAPGSTSSTAESPGP

SEQ ID NO: 470 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 471 - protein, 36 aa, Artificial Sequence
  Description of Artificial Sequence: Synthetic polypeptide
GSTSSTAESPGPGTSPSGESSTAPGTSPSGESSTAP

SEQ ID NO: 472 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 473 - protein, 36 aa, Artificial Sequence
  Description of Artificial Sequence: Synthetic polypeptide
GTSPSGESSTAPGTSPSGESSTAPGTSPSGESSTAP

SEQ ID NO: 474 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 475 - protein, 36 aa, Artificial Sequence; identical to SEQ ID NO: 409
  Description of Artificial Sequence: Synthetic polypeptide

SEQ ID NO: 476 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 477 - protein, 36 aa, Artificial Sequence
  Description of Artificial Sequence: Synthetic polypeptide
GSTSESPSGTAPGTSPSGESSTAPGTSPSGESSTAP

SEQ ID NO: 478 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 479 - protein, 36 aa, Artificial Sequence
  Description of Artificial Sequence: Synthetic polypeptide
GSTSESPSGTAPGTSTPESGSASPGSTSSTAESPGP

SEQ ID NO: 480 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 481 - protein, 36 aa, Artificial Sequence; identical to SEQ ID NO: 455
  Description of Artificial Sequence: Synthetic polypeptide

SEQ ID NO: 482 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 483 - protein, 36 aa, Artificial Sequence
  Description of Artificial Sequence: Synthetic polypeptide
GSTSESPSGTAPGTSTPESGSASPGTSTPESGSASP

SEQ ID NO: 484 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 485 - protein, 36 aa, Artificial Sequence; identical to SEQ ID NO: 483
  Description of Artificial Sequence: Synthetic polypeptide

SEQ ID NO: 486 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 487 - protein, 12 aa, Artificial Sequence
  Description of Artificial Sequence: Synthetic peptide
GTPGSGTASSSP

SEQ ID NO: 488 - protein, 12 aa, Artificial Sequence
  Description of Artificial Sequence: Synthetic peptide
GSSTPSGATGSP

SEQ ID NO: 489 - protein, 12 aa, Artificial Sequence
  Description of Artificial Sequence: Synthetic peptide
GSSPSASTGTGP

SEQ ID NO: 490 - protein, 12 aa, Artificial Sequence
  Description of Artificial Sequence: Synthetic peptide
GASPGTSSTGSP

SEQ ID NO: 491 - DNA, 36 bp, Artificial Sequence
  Description of Artificial Sequence: Synthetic oligonucleotide
aggtacycckggyagcggtacygcwtcttcytctcc

SEQ ID NO: 492 - DNA, 36 bp, Artificial Sequence
  Description of Artificial Sequence: Synthetic oligonucleotide
acctggagargaagawgcrgtaccgctrccmggrgt

SEQ ID NO: 493 - DNA, 36 bp, Artificial Sequence
  Description of Artificial Sequence: Synthetic oligonucleotide
aggtagctctacyccktctggtgcwacyggytcycc

SEQ ID NO: 494 - DNA, 36 bp, Artificial Sequence
  Description of Artificial Sequence: Synthetic oligonucleotide
acctggrgarccrgtwgcaccagamggrgtagagct

SEQ ID NO: 495 - DNA, 36 bp, Artificial Sequence
  Description of Artificial Sequence: Synthetic oligonucleotide
aggttctagcccktctgcwtcyacyggtacyggycc

SEQ ID NO: 496 - DNA, 36 bp, Artificial Sequence
  Description of Artificial Sequence: Synthetic oligonucleotide
acctggrccrgtaccrgtrgawgcagamgggctaga

SEQ ID NO: 497 - DNA, 36 bp, Artificial Sequence
  Description of Artificial Sequence: Synthetic oligonucleotide
aggtgcwtcycckggyacyagctctacyggttctcc

SEQ ID NO: 498 - DNA, 36 bp, Artificial Sequence
  Description of Artificial Sequence: Synthetic oligonucleotide
acctggagaaccrgtagagctrgtrccmggrgawgc

SEQ ID NO: 499 - DNA, 24 bp, Artificial Sequence
  Description of Artificial Sequence: Synthetic oligonucleotide
aggttcgtcttcactcgagggtac

SEQ ID NO: 500 - DNA, 16 bp, Artificial Sequence
  Description of Artificial Sequence: Synthetic oligonucleotide
cctcgagtgaagacga

SEQ ID NO: 501 - protein, 36 aa, Artificial Sequence
  Description of Artificial Sequence: Synthetic polypeptide
GASPGTSSTGSPGTPGSGTASSSPGSSTPSGATGSP

SEQ ID NO: 502 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 503 - protein, 36 aa, Artificial Sequence
  Description of Artificial Sequence: Synthetic polypeptide
GSSTPSGATGSPGSSPSASTGTGPGSSTPSGATGSP

SEQ ID NO: 504 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 505 - protein, 36 aa, Artificial Sequence
  Description of Artificial Sequence: Synthetic polypeptide
GASPGTSSTGSPGSSPSASTGTGPGSSTPSGATGSP

SEQ ID NO: 506 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 507 - protein, 36 aa, Artificial Sequence
  Description of Artificial Sequence: Synthetic polypeptide
GTPGSGTASSSPGSSTPSGATGSPGASPGTSSTGSP

SEQ ID NO: 508 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 509 - protein, 36 aa, Artificial Sequence
  Description of Artificial Sequence: Synthetic polypeptide
GTPGSGTASSSPGASPGTSSTGSPGSRPSASTGTGP

SEQ ID NO: 510 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 511 - protein, 36 aa, Artificial Sequence
  Description of Artificial Sequence: Synthetic polypeptide
GASPGTSSTGSPGSSTPSGATGSPGASPGTSSTGSP

SEQ ID NO: 512 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 513 - protein, 36 aa, Artificial Sequence
  Description of Artificial Sequence: Synthetic polypeptide
GTPGSGTASSSPGSSTPSGATGSPGSSTPSGATGSP

SEQ ID NO: 514 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 515 - protein, 36 aa, Artificial Sequence
  Description of Artificial Sequence: Synthetic polypeptide
GASPGTSSTGSPGASPGTSSTGSPGASPGTSSTGSP

SEQ ID NO: 516 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 517 - protein, 36 aa, Artificial Sequence
  Description of Artificial Sequence: Synthetic polypeptide
GSSTPSGATGSPGSSPSASTGTGPGASPGTSSTGSP

SEQ ID NO: 518 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 519 - protein, 36 aa, Artificial Sequence
  Description of Artificial Sequence: Synthetic polypeptide
GSSTPSGATGSPGSSTPSGATGSPGTPGSGTASSSP

SEQ ID NO: 520 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 521 - protein, 36 aa, Artificial Sequence
  Description of Artificial Sequence: Synthetic polypeptide
GSSTPSGATGSPGSSTPSGATGSPGASPGTSSTGSP

SEQ ID NO: 522 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 523 - protein, 36 aa, Artificial Sequence
  Description of Artificial Sequence: Synthetic polypeptide
GTPGSGTASSSPGSSPSASTGTGPGSSTPSGATGSP

SEQ ID NO: 524 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 525 - protein, 36 aa, Artificial Sequence
  Description of Artificial Sequence: Synthetic polypeptide
GASPGTSSTGSPGSSPSASTGTGPGTPGSGTASSSP

SEQ ID NO: 526 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 527 - protein, 36 aa, Artificial Sequence; identical to SEQ ID NO: 521
  Description of Artificial Sequence: Synthetic polypeptide

SEQ ID NO: 528 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 529 - protein, 36 aa, Artificial Sequence
  Description of Artificial Sequence: Synthetic polypeptide
GTPGSGTASSSPGSSTPSGATGSPGSSPSASTGTGP

SEQ ID NO: 530 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 531 - protein, 36 aa, Artificial Sequence
  Description of Artificial Sequence: Synthetic polypeptide
GSSTPSGATGSPGTPGSGTASSSPGTPGSGTASSSP

SEQ ID NO: 532 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 533 - protein, 36 aa, Artificial Sequence; identical to SEQ ID NO: 507
  Description of Artificial Sequence: Synthetic polypeptide

SEQ ID NO: 534 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 535 - protein, 36 aa, Artificial Sequence; identical to SEQ ID NO: 521
  Description of Artificial Sequence: Synthetic polypeptide

SEQ ID NO: 536 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 537 - protein, 36 aa, Artificial Sequence; identical to SEQ ID NO: 501
  Description of Artificial Sequence: Synthetic polypeptide

SEQ ID NO: 538 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 539 - protein, 36 aa, Artificial Sequence
  Description of Artificial Sequence: Synthetic polypeptide
GSSPSASTGTGPGSSTPSGATGSPGTPGSGTASSSP

SEQ ID NO: 540 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 541 - protein, 36 aa, Artificial Sequence; identical to SEQ ID NO: 505
  Description of Artificial Sequence: Synthetic polypeptide

SEQ ID NO: 542 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 543 - protein, 36 aa, Artificial Sequence
  Description of Artificial Sequence: Synthetic polypeptide
GASPGTSSTGSPGSSTPSGATGSPGSSTPSGATGSP

SEQ ID NO: 544 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 545 - protein, 36 aa, Artificial Sequence
  Description of Artificial Sequence: Synthetic polypeptide
GTPGSGTASSSPGSSTPSGATGSPGTPGSGTASSSP

SEQ ID NO: 546 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 547 - protein, 36 aa, Artificial Sequence; identical to SEQ ID NO: 433
  Description of Artificial Sequence: Synthetic polypeptide

SEQ ID NO: 548 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 549 - protein, 36 aa, Artificial Sequence
  Description of Artificial Sequence: Synthetic polypeptide
GASPGTSSTGSPGSSPSASTGTGPGSSPSASTGTGP

SEQ ID NO: 550 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 551 - protein, 36 aa, Artificial Sequence
  Description of Artificial Sequence: Synthetic polypeptide
GTPGSGTASSSPGASPGTSSTGSPGASPGTSSTGSP

SEQ ID NO: 552 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 553 - protein, 36 aa, Artificial Sequence
  Description of Artificial Sequence: Synthetic polypeptide
GSSTPSGATGSPGASPGTSSTGSPGSSTPSGATGSP

SEQ ID NO: 554 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 555 - protein, 36 aa, Artificial Sequence
  Description of Artificial Sequence: Synthetic polypeptide
GSSTPSGATGSPGTPGSGTASSSPGSSTPSGATGSP

SEQ ID NO: 556 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 557 - protein, 36 aa, Artificial Sequence; identical to SEQ ID NO: 505
  Description of Artificial Sequence: Synthetic polypeptide

SEQ ID NO: 558 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 559 - protein, 36 aa, Artificial Sequence
  Description of Artificial Sequence: Synthetic polypeptide
GSSTPSGATGSPGSSTPSGATGSPGSSTPSGATGSP

SEQ ID NO: 560 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 561 - protein, 36 aa, Artificial Sequence
  Description of Artificial Sequence: Synthetic polypeptide
GASPGTSSTGSPGTPGSGTASSSPGASPGTSSTGSP

SEQ ID NO: 562 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 563 - protein, 36 aa, Artificial Sequence; identical to SEQ ID NO: 517
  Description of Artificial Sequence: Synthetic polypeptide

SEQ ID NO: 564 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 565 - protein, 36 aa, Artificial Sequence
  Description of Artificial Sequence: Synthetic polypeptide
GASPGTSSTGSPGSSTPSGATGSPGSSPSASTGTGP

SEQ ID NO: 566 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 567 - protein, 36 aa, Artificial Sequence; identical to SEQ ID NO: 507
  Description of Artificial Sequence: Synthetic polypeptide

SEQ ID NO: 568 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 569 - protein, 36 aa, Artificial Sequence; identical to SEQ ID NO: 555
  Description of Artificial Sequence: Synthetic polypeptide

SEQ ID NO: 570 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 571 - protein, 36 aa, Artificial Sequence
  Description of Artificial Sequence: Synthetic polypeptide
GSSPSASTGTGPGSSPSASTGTGPGASPGTSSTGSP

SEQ ID NO: 572 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 573 - protein, 36 aa, Artificial Sequence
  Description of Artificial Sequence: Synthetic polypeptide
GTPGSGTASSSPGSSTPSGATGSPGSNPSASTGTGP

SEQ ID NO: 574 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 575 - protein, 36 aa, Artificial Sequence
  Description of Artificial Sequence: Synthetic polypeptide
GSSPSASTGTGPGSSTPSGATGSPGASPGTSSTGSP

SEQ ID NO: 576 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 577 - protein, 36 aa, Artificial Sequence
  Description of Artificial Sequence: Synthetic polypeptide
GSSTPSGATGSPGASPGTSSTGSPGTPGSGTASSSP

SEQ ID NO: 578 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 579 - protein, 36 aa, Artificial Sequence; identical to SEQ ID NO: 559
  Description of Artificial Sequence: Synthetic polypeptide

SEQ ID NO: 580 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 581 - protein, 36 aa, Artificial Sequence; identical to SEQ ID NO: 501
  Description of Artificial Sequence: Synthetic polypeptide

SEQ ID NO: 582 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 583 - protein, 36 aa, Artificial Sequence
  Description of Artificial Sequence: Synthetic polypeptide
GSSTPSGATGSPGSSPSASTGTGPGSSPSASTGTGP

SEQ ID NO: 584 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 585 - protein, 36 aa, Artificial Sequence; identical to SEQ ID NO: 549
  Description of Artificial Sequence: Synthetic polypeptide

SEQ ID NO: 586 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 587 - protein, 36 aa, Artificial Sequence; identical to SEQ ID NO: 525
  Description of Artificial Sequence: Synthetic polypeptide

SEQ ID NO: 588 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 589 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 590 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 591 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 592 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 593 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 594 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 595 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 596 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 597 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 598 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 599 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 600 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 601 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 602 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 603 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 604 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 605 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 606 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 607 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 608 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 609 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 610 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 611 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 612 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 613 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 614 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 615 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 616 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 617 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 618 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 619 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 620 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 621 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 622 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 623 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 624 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 625 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 626 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 627 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 628 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 629 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 630 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 631 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 632 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 633 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 634 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 635 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 636 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 637 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 638 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 639 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 640 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 641 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 642 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 643 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 644 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 645 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 646 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 647 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 648 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 649 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 650 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 651 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 652 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 653 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 654 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 655 - DNA, 57 bp, Artificial Sequence
  Description of Artificial Sequence: Synthetic oligonucleotide
aggtgcaagcgcaagcggcgcgccaagcacgggaggttcgtcttcactcgagggtac

SEQ ID NO: 656 - DNA, 49 bp, Artificial Sequence
  Description of Artificial Sequence: Synthetic oligonucleotide
cctcgagtgaagacgaacctcccgtgcttggcgcgccgcttgcgcttgc

SEQ ID NO: 657 - protein, 11 aa, Artificial Sequence
  Description of Artificial Sequence: Synthetic peptide
GASASGAPSTG

SEQ ID NO: 658 - DNA, 57 bp, Artificial Sequence
  Description of Artificial Sequence: Synthetic oligonucleotide
aggtccagaaccaacggggccggccccaagcggaggttcgtcttcactcgagggtac

SEQ ID NO: 659 - DNA, 49 bp, Artificial Sequence
  Description of Artificial Sequence: Synthetic oligonucleotide
cctcgagtgaagacgaacctccgcttggggccggccccgttggttctgg

SEQ ID NO: 660 - protein, 11 aa, Artificial Sequence
  Description of Artificial Sequence: Synthetic peptide
GPEPTGPAPSG

SEQ ID NO: 661 - protein, 13 aa, Artificial Sequence
  Description of Artificial Sequence: Synthetic peptide
MASPAGSPTSTEE

SEQ ID NO: 662 - protein, 13 aa, Artificial Sequence
  Description of Artificial Sequence: Synthetic peptide
MATSESATPESGP

SEQ ID NO: 663 - protein, 13 aa, Artificial Sequence
  Description of Artificial Sequence: Synthetic peptide
MATSPSGESSTAP

SEQ ID NO: 664 - protein, 13 aa, Artificial Sequence
  Description of Artificial Sequence: Synthetic peptide
MESTSSTAESPGP

SEQ ID NO: 665 - protein, 13 aa, Artificial Sequence
  Description of Artificial Sequence: Synthetic peptide
MASSTPSGATGSP

SEQ ID NO: 666 - protein, 13 aa, Artificial Sequence
  Description of Artificial Sequence: Synthetic peptide
MEASPGTSSTGSP

SEQ ID NO: 667 - protein, 11 aa, Artificial Sequence
  Description of Artificial Sequence: Synthetic peptide
MASTPESGSSG

SEQ ID NO: 668 - DNA, 51 bp, Artificial Sequence
  Description of Artificial Sequence: Synthetic oligonucleotide
atggctagtccggctggctctccgacctccactgaggaaggtacttctact

SEQ ID NO: 669 - DNA, 51 bp, Artificial Sequence
  Description of Artificial Sequence: Synthetic oligonucleotide
atggctagtcctgctggctctccaacctccactgaggaaggtacttctact

SEQ ID NO: 670 - DNA, 51 bp, Artificial Sequence
  Description of Artificial Sequence: Synthetic oligonucleotide
atggctagtccagcaggctctcctacctccaccgaggaaggtacttctact

SEQ ID NO: 671 - DNA, 51 bp, Artificial Sequence
  Description of Artificial Sequence: Synthetic oligonucleotide
atggctagtcctgctggctctccgacctctactgaggaaggtacttctact

SEQ ID NO: 672 - DNA, 51 bp, Artificial Sequence
  Description of Artificial Sequence: Synthetic oligonucleotide
atggctacatccgaaagcgcaacccctgagtccggtccaggtacttctact

SEQ ID NO: 673 - DNA, 51 bp, Artificial Sequence
  Description of Artificial Sequence: Synthetic oligonucleotide
atggctacatccgaaagcgcaacccctgaatctggtccaggtacttctact

SEQ ID NO: 674 - DNA, 51 bp, Artificial Sequence
  Description of Artificial Sequence: Synthetic oligonucleotide
atggctacgtctgaaagcgctactccggaatctggtccaggtacttctact

SEQ ID NO: 675 - DNA, 51 bp, Artificial Sequence
  Description of Artificial Sequence: Synthetic oligonucleotide
atggctacgtccgaaagcgctacccctgaatccggtccaggtacttctact

SEQ ID NO: 676 - DNA, 51 bp, Artificial Sequence
  Description of Artificial Sequence: Synthetic oligonucleotide
atggctagttctaccccgtctggtgcaaccggttccccaggtacttctact

SEQ ID NO: 677 - DNA, 51 bp, Artificial Sequence
  Description of Artificial Sequence: Synthetic oligonucleotide
atggctagctccactccgtctggtgctaccggttccccaggtacttctact

SEQ ID NO: 678 - DNA, 51 bp, Artificial Sequence
  Description of Artificial Sequence: Synthetic oligonucleotide
atggctagctctactccgtctggtgctactggttccccaggtacttctact

SEQ ID NO: 679 - DNA, 51 bp, Artificial Sequence
  Description of Artificial Sequence: Synthetic oligonucleotide
atggctagttctaccccttctggtgctactggttctccaggtacttctact

SEQ ID NO: 680 - DNA, 180 bp, Artificial Sequence
  Description of Artificial Sequence: Synthetic polynucleotide
atggctagtcctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 681 - DNA, 180 bp, Artificial Sequence; identical to SEQ ID NO: 680
  Description of Artificial Sequence: Synthetic polynucleotide

SEQ ID NO: 682 - DNA, 180 bp, Artificial Sequence
  Description of Artificial Sequence: Synthetic polynucleotide
atggctagtcctgctggctctccaacctccactgaggaaggtacttctaccgaaccgtccgagggtagcgcaccaggtagcccagcaggttctcctacctccaccgaggaaggtacttctaccgaaccgtccgagggtagcgcaccaggtacttctactgaaccgtctgaaggcagcgca

SEQ ID NO: 683 - DNA, 180 bp, Artificial Sequence
  Description of Artificial Sequence: Synthetic polynucleotide
atggctagtcctgctggctctccgacctctactgaggaaggtacttctactgaaccgtctgaaggcagcgcaccaggtagcgaaccggctacttccggttctgaaaccccaggtagcccagcaggttctccaacttctactgaagaaggtacttctactgaaccgtctgaaggcagcgca

SEQ ID NO: 684 - DNA, 180 bp, Artificial Sequence
  Description of Artificial Sequence: Synthetic polynucleotide
atggctagtcctgctggctctccaacctccactgaggaaggtaccccgggtagcggtactgcttcttcctctccaggtagctctaccccttctggtgcaaccggctctccaggtgcttctccgggcaccagctctaccggttctccaggtacttctactgaaccgtctgaaggcagcgca

SEQ ID NO: 685 - DNA, 180 bp, Artificial Sequence; identical to SEQ ID NO: 683
  Description of Artificial Sequence: Synthetic polynucleotide

SEQ ID NO: 686 - DNA, 180 bp, Artificial Sequence
  Description of Artificial Sequence: Synthetic polynucleotide
atggctagtcctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 687 - DNA, 180 bp, Artificial Sequence
  Description of Artificial Sequence: Synthetic polynucleotide
atggctagtcctgctggctctccgacctctactgaggaaggtacctctactccggaaagcggttccgcatctccaggttctaccagcgaatccccgtctggcaccgcaccaggttctactagctctactgctgaatctccgggcccaggtacttctactgaaccgtctgaaggcagcgca

SEQ ID NO: 688 - DNA, 180 bp, Artificial Sequence; identical to SEQ ID NO: 686
  Description of Artificial Sequence: Synthetic polynucleotide

SEQ ID NO: 689 - DNA, 180 bp, Artificial Sequence; identical to SEQ ID NO: 687
  Description of Artificial Sequence: Synthetic polynucleotide

SEQ ID NO: 690 - DNA, 180 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 691 - DNA, 180 bp, Artificial Sequence
  Description of Artificial Sequence: Synthetic polynucleotide
atggctgaacctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 692 - DNA, 180 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgag

SEQ ID NO: 693 - DNA, 180 bp, Artificial Sequence
  Description of Artificial Sequence: Synthetic polynucleotide
atggctgaaactgctggctctccaacctccactgaggaaggtgcatccccgggcaccagctctaccggttctccaggtagctctaccccgtctggtgctaccggctctccaggtagctctaccccgtctggtgctactggctctccaggtagcccggctggctctcctacctctactgag

SEQ ID NO: 694 - DNA, 26 bp, Artificial Sequence
  Description of Artificial Sequence: Synthetic primer
gaaggagatatacatatggctgaaga

SEQ ID NO: 695 - DNA, 41 bp, Artificial Sequence
  Description of Artificial Sequence: Synthetic primer
tgttaatccaacccagaaaggaggtcgagaccgattgttct

SEQ ID NO: 696 - DNA, 26 bp, Artificial Sequence
  Description of Artificial Sequence: Synthetic primer
gaaggagatatacatatggctgaaga

SEQ ID NO: 697 - DNA, 41 bp, Artificial Sequence; identical to SEQ ID NO: 695
  Description of Artificial Sequence: Synthetic primer

SEQ ID NO: 698 - DNA, 3831 bp, Artificial Sequence
  Description of Artificial Sequence: Synthetic polynucleotide
atggctgaagatcctcagggcgatgctgctcaaaaaaccgacacctctcaccatgatcaggaccatccgacttttaacaaaatcaccccgaacctggcggaattcgcattctccctctatcgtcagctggctcaccagtctaactccactaacattttcttctccccggtttctatcgctaccgcattcgctatgctctctcttggcactaaagctgacacccacgacgagattcttgagggtcttaacttcaatctgaccgaaatcccggaggctcagatccacgagggctttcaggaactgctgcgtaccctgaatcaacctgattctcaactgcaacttactaccggtaacggtctgttcctttccgagggtcttaagcttgttgacaaattcctggaagatgtcaaaaaactctatcattctgaagctttcaccgttaacttcggcgacaccgaagaggcaaaaaagcagatcaacgactacgtagagaaaggtacccaaggtaagattgttgacctggttaaagaactcgatcgcgacaccgtctttgctctggttaactacatcttctttaagggcaaatgggagcgcccgttcgaagttaaagacaccgaagaggaagattttcacgttgatcaggttaccaccgttaaggtccctatgatgaaacgtctgggtatgttcaacatccagcactgtaagaaactctcctcttgggttcttctgatgaaatacctgggtaacgcgactgctatctttttccttccggacgaaggtaaactgcagcatctcgaaaatgagcttactcacgacatcatcaccaaatttctggaaaacgaggatcgccgttctgcttctctgcacctgcctaagctgtccattactggtacttatgacctgaaatctgttctgggccaactgggcattaccaaggtgttttctaacggtgctgacctttctggcgttactgaggaggctccgctgaaactgtctaaagctgtgcacaaagcagttctcaccattgacgaaaaaggtaccgaagcagcaggtgcgatgttcctcgaagctatcccgatgtctatccctccggaagtgaaattcaataaaccgttcgttttcctgatgatcgagcagaataccaagtctccgctgttcatgggtaaagttgttaatccaacccagaaaggaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttaaactagttaa

SEQ ID NO: 699 - protein, 1272 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 700 - DNA, 3960 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtgaagacccgcagggtgacgcggcacagaaaaccgacacctctcaccacgaccaagaccaccctaccttcaacaaaatcaccccgaacctggcggaattcgcattctccctctatcgtcagctggctcaccagtctaactccactaacattttcttctccccggtttctatcgctaccgcattcgctatgctctctcttggcactaaagctgacacccacgacgagattcttgagggtcttaacttcaatctgaccgaaatcccggaggctcagatccacgagggctttcaggaactgctgcgtaccctgaatcaacctgattctcaactgcaacttactaccggtaacggtctgttcctttccgagggtcttaagcttgttgacaaattcctggaagatgtcaaaaaactctatcattctgaagctttcaccgttaacttcggcgacaccgaagaggcaaaaaagcagatcaacgactacgtagagaaaggtacccaaggtaagattgttgacctggttaaagaactcgatcgcgacaccgtctttgctctggttaactacatcttctttaagggcaaatgggagcgcccgttcgaagttaaagacaccgaagaggaagattttcacgttgatcaggttaccaccgttaaggtccctatgatgaaacgtctgggtatgttcaacatccagcactgtaagaaactctcctcttgggttcttctgatgaaatacctgggtaacgcgactgctatctttttccttccggacgaaggtaaactgcagcatctcgaaaatgagcttactcacgacatcatcaccaaatttctggaaaacgaggatcgccgttctgcttctctgcacctgcctaagctgtccattactggtacttatgacctgaaatctgttctgggccaactgggcattaccaaggtgttttctaacggtgctgacctttctggcgttactgaggaggctccgctgaaactgtctaaagctgtgcacaaagcagttctcaccattgacgaaaaaggtaccgaagcagcaggtgcgatgttcctcgaagctatcccgatgtctatccctccggaagtgaaattcaataaaccgttcgttttcctgatgatcgagcagaataccaagtctccgctgttcatgggtaaagttgttaatccaacccagaaataa

SEQ ID NO: 701 - protein, 1319 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 702 - DNA, 2061 bp, Artificial Sequence
  Description of Artificial Sequence: Synthetic polynucleotide
atggctgaagatcctcagggcgatgctgctcaaaaaaccgacacctctcaccatgatcaggaccatccgacttttaacaaaatcaccccgaacctggcggaattcgcattctccctctatcgtcagctggctcaccagtctaactccactaacattttcttctccccggtttctatcgctaccgcattcgctatgctctctcttggcactaaagctgacacccacgacgagattcttgagggtcttaacttcaatctgaccgaaatcccggaggctcagatccacgagggctttcaggaactgctgcgtaccctgaatcaacctgattctcaactgcaacttactaccggtaacggtctgttcctttccgagggtcttaagcttgttgacaaattcctggaagatgtcaaaaaactctatcattctgaagctttcaccgttaacttcggcgacaccgaagaggcaaaaaagcagatcaacgactacgtagagaaaggtacccaaggtaagattgttgacctggttaaagaactcgatcgcgacaccgtctttgctctggttaactacatcttctttaagggcaaatgggagcgcccgttcgaagttaaagacaccgaagaggaagattttcacgttgatcaggttaccaccgttaaggtccctatgatgaaacgtctgggtatgttcaacatccagcactgtaagaaactctcctcttgggttcttctgatgaaatacctgggtaacgcgactgctatctttttccttccggacgaaggtaaactgcagcatctcgaaaatgagcttactcacgacatcatcaccaaatttctggaaaacgaggatcgccgttctgcttctctgcacctgcctaagctgtccattactggtacttatgacctgaaatctgttctgggccaactgggcattaccaaggtgttttctaacggtgctgacctttctggcgttactgaggaggctccgctgaaactgtctaaagctgtgcacaaagcagttctcaccattgacgaaaaaggtaccgaagcagcaggtgcgatgttcctcgaagctatcccgatgtctatccctccggaagtgaaattcaataaaccgttcgttttcctgatgatcgagcagaataccaagtctccgctgttcatgggtaaagttgttaatccaacccagaaaggaggtagccctgctggctctccgacttctactgaggaaggtagcccggctggttctccgacttctactgaggaaggtacttctaccgaaccttccgaaggtagcgctccaggtagcgaaccggcaacctccggctctgaaaccccaggtacctctgaaagcgctactcctgaatccggcccaggtagcccggcaggttctccgacttccactgaggaaggtagcccggctggttctccgacttccaccgaggaaggtacctctactgaaccttctgagggtagcgctccaggtacctctactgaaccttccgaaggcagcgctccaggtagcgaaccggcaacctccggctctgaaactccaggtacttctgaaagcgctactccggaatccggcccaggtagcgaaccggctacttccggctctgaaaccccaggtacttctactgaaccttccgaaggtagcgctccaggtagcgaacctgctacttctggttctgaaaccccaggtagcccggctggctctccgacctccaccgaggaaggtacctctaccgaaccgtctgaaggtagcgcaccaggtacctctgaaagcgcaactcctgagtccggtccaggtacttctgaaagcgcaaccccggagtctggcccaggtagcgaacctgcaacctctggctctgaaaccccaggtacctctgaaagcgctactcctgaatctggcccaggtacttctactgaaccgtccgagggcagcgcaccaggtacttctgaaagcgcaacccctgaatccggtccaggtagcgaaccggctacttctggctctgagactccaggtacttctaccgaaccgtccgaaggtagcgcaccaggttaa

SEQ ID NO: 703 - protein, 686 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSPAGSPTSTEEGSPAGSPTSTEEGTSTEPSEGSAPGSEPATSGSETPGTSESATPESGPGSPAGSPTSTEEGSPAGSPTSTEEGTSTEPSEGSAPGTSTEPSEGSAPGSEPATSGSETPGTSESATPESGPGSEPATSGSETPGTSTEPSEGSAPGSEPATSGSETPGSPAGSPTSTEEGTSTEPSEGSAPGTSESATPESGPGTSESATPESGPGSEPATSGSETPGTSESATPESGPGTSTEPSEGSAPGTSESATPESGPGSEPATSGSETPGTSTEPSEGSAPG

SEQ ID NO: 704 - DNA, 2925 bp, Artificial Sequence
  Description of Artificial Sequence: Synthetic polynucleotide
atggctgaagatcctcagggcgatgctgctcaaaaaaccgacacctctcaccatgatcaggaccatccgacttttaacaaaatcaccccgaacctggcggaattcgcattctccctctatcgtcagctggctcaccagtctaactccactaacattttcttctccccggtttctatcgctaccgcattcgctatgctctctcttggcactaaagctgacacccacgacgagattcttgagggtcttaacttcaatctgaccgaaatcccggaggctcagatccacgagggctttcaggaactgctgcgtaccctgaatcaacctgattctcaactgcaacttactaccggtaacggtctgttcctttccgagggtcttaagcttgttgacaaattcctggaagatgtcaaaaaactctatcattctgaagctttcaccgttaacttcggcgacaccgaagaggcaaaaaagcagatcaacgactacgtagagaaaggtacccaaggtaagattgttgacctggttaaagaactcgatcgcgacaccgtctttgctctggttaactacatcttctttaagggcaaatgggagcgcccgttcgaagttaaagacaccgaagaggaagattttcacgttgatcaggttaccaccgttaaggtccctatgatgaaacgtctgggtatgttcaacatccagcactgtaagaaactctcctcttgggttcttctgatgaaatacctgggtaacgcgactgctatctttttccttccggacgaaggtaaactgcagcatctcgaaaatgagcttactcacgacatcatcaccaaatttctggaaaacgaggatcgccgttctgcttctctgcacctgcctaagctgtccattactggtacttatgacctgaaatctgttctgggccaactgggcattaccaaggtgttttctaacggtgctgacctttctggcgttactgaggaggctccgctgaaactgtctaaagctgtgcacaaagcagttctcaccattgacgaaaaaggtaccgaagcagcaggtgcgatgttcctcgaagctatcccgatgtctatccctccggaagtgaaattcaataaaccgttcgttttcctgatgatcgagcagaataccaagtctccgctgttcatgggtaaagttgttaatccaacccagaaaggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttaa

SEQ ID NO: 705 - protein, 974 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 706 - protein, 7 aa, Artificial Sequence
  Description of Artificial Sequence: Synthetic peptide
KLTRAET

SEQ ID NO: 707 - protein, 8 aa, Artificial Sequence
  Description of Artificial Sequence: Synthetic peptide
LGPVSGVP

SEQ ID NO: 708 - protein, 8 aa, Artificial Sequence
  Description of Artificial Sequence: Synthetic peptide
GPAGLGGA

SEQ ID NO: 709 - protein, 8 aa, Artificial Sequence
  Description of Artificial Sequence: Synthetic peptide
GPAGLRGA

SEQ ID NO: 710 - protein, 8 aa, Artificial Sequence
  Description of Artificial Sequence: Synthetic peptide
APLGLRLR

SEQ ID NO: 711 - protein, 8 aa, Artificial Sequence
  Description of Artificial Sequence: Synthetic peptide
PALPLVAQ

SEQ ID NO: 712 - protein, 36 aa, Artificial Sequence; identical to SEQ ID NO: 311
  Description of Artificial Sequence: Synthetic polypeptide

SEQ ID NO: 713 - protein, 36 aa, Artificial Sequence; identical to SEQ ID NO: 313
  Description of Artificial Sequence: Synthetic polypeptide

SEQ ID NO: 714 - protein, 36 aa, Artificial Sequence; identical to SEQ ID NO: 501
  Description of Artificial Sequence: Synthetic polypeptide

SEQ ID NO: 715 - protein, 36 aa, Artificial Sequence; identical to SEQ ID NO: 503
  Description of Artificial Sequence: Synthetic polypeptide

SEQ ID NO: 716 - protein, 42 aa, Artificial Sequence; identical to SEQ ID NO: 45
  Description of Artificial Sequence: Synthetic polypeptide

SEQ ID NO: 717 - protein, 42 aa, Artificial Sequence; identical to SEQ ID NO: 45
  Description of Artificial Sequence: Synthetic polypeptide

SEQ ID NO: 718 - protein, 42 aa, Artificial Sequence; identical to SEQ ID NO: 48
  Description of Artificial Sequence: Synthetic polypeptide

SEQ ID NO: 719 - protein, 42 aa, Artificial Sequence; identical to SEQ ID NO: 49
  Description of Artificial Sequence: Synthetic polypeptide

SEQ ID NO: 720 - protein, 144 aa, Artificial Sequence; identical to SEQ ID NO: 54
  Description of Artificial Sequence: Synthetic polypeptide

SEQ ID NO: 721 - protein, 144 aa, Artificial Sequence; identical to SEQ ID NO: 56
  Description of Artificial Sequence: Synthetic polypeptide

SEQ ID NO: 722 - protein, 288 aa, Artificial Sequence; identical to SEQ ID NO: 60
  Description of Artificial Sequence: Synthetic polypeptide

SEQ ID NO: 723 - protein, 288 aa, Artificial Sequence; identical to SEQ ID NO: 63
  Description of Artificial Sequence: Synthetic polypeptide

SEQ ID NO: 724 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 725 - protein, 576 aa, Artificial Sequence; identical to SEQ ID NO: 66
  Description of Artificial Sequence: Synthetic polypeptide

SEQ ID NO: 726 - protein, 576 aa, Artificial Sequence; identical to SEQ ID NO: 67
  Description of Artificial Sequence: Synthetic polypeptide

SEQ ID NO: 727 - protein, 576 aa, Artificial Sequence; identical to SEQ ID NO: 69
  Description of Artificial Sequence: Synthetic polypeptide

SEQ ID NO: 728 - protein, 540 aa, Artificial Sequence; identical to SEQ ID NO: 65
  Description of Artificial Sequence: Synthetic polypeptide

SEQ ID NO: 729 - protein, 836 aa, Artificial Sequence; identical to SEQ ID NO: 71
  Description of Artificial Sequence: Synthetic polypeptide

SEQ ID NO: 730 - protein, 864 aa, Artificial Sequence; identical to SEQ ID NO: 72
  Description of Artificial Sequence: Synthetic polypeptide

SEQ ID NO: 731 - protein, 875 aa, Artificial Sequence; identical to SEQ ID NO: 73
  Description of Artificial Sequence: Synthetic polypeptide
  MOD_RES (430)..(432): Any amino acid
  MOD_RES (443)..(446): Any amino acid

SEQ ID NO: 732 - protein, 864 aa, Artificial Sequence; identical to SEQ ID NO: 74
  Description of Artificial Sequence: Synthetic polypeptide

SEQ ID NO: 733 - protein, 875 aa, Artificial Sequence; identical to SEQ ID NO: 75
  Description of Artificial Sequence: Synthetic polypeptide

SEQ ID NO: 734 - protein, 1318 aa, Artificial Sequence; identical to SEQ ID NO: 78
  Description of Artificial Sequence: Synthetic polypeptide

SEQ ID NO: 735 - protein, 924 aa, Artificial Sequence; identical to SEQ ID NO: 77
  Description of Artificial Sequence: Synthetic polypeptide

SEQ ID NO: 736 - protein, 913 aa, Artificial Sequence; identical to SEQ ID NO: 76
  Description of Artificial Sequence: Synthetic polypeptide

SEQ ID NO: 737 - protein, 864 aa, Artificial Sequence; identical to SEQ ID NO: 79
  Description of Artificial Sequence: Synthetic polypeptide

SEQ ID NO: 738 - protein, 4 aa, Artificial Sequence
  Description of Artificial Sequence: Synthetic peptide
GGSG

SEQ ID NO: 739 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 740 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 741 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 742 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 743 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 744 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 745 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 746 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 747 - protein, 576 aa, Artificial Sequence; identical to SEQ ID NO: 66
  Description of Artificial Sequence: Synthetic polypeptide

SEQ ID NO: 748 - protein, 577 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 749 - protein, 540 aa, Artificial Sequence; identical to SEQ ID NO: 65
  Description of Artificial Sequence: Synthetic polypeptide

SEQ ID NO: 750 - protein, 504 aa, Artificial Sequence; identical to SEQ ID NO: 724
  Description of Artificial Sequence: Synthetic polypeptide

SEQ ID NO: 751 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 752 - protein, 875 aa, Artificial Sequence; identical to SEQ ID NO: 73
  Description of Artificial Sequence: Synthetic polypeptide
  MOD_RES (430)..(432): Any amino acid
  MOD_RES (443)..(446): Any amino acid

SEQ ID NO: 753 - protein, 868 aa, Artificial Sequence
  Description of Artificial Sequence: Synthetic polypeptide
GGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 754 - protein, 875 aa, Artificial Sequence; identical to SEQ ID NO: 75
  Description of Artificial Sequence: Synthetic polypeptide

SEQ ID NO: 755 - protein, 1318 aa, Artificial Sequence; identical to SEQ ID NO: 78
  Description of Artificial Sequence: Synthetic polypeptide

SEQ ID NO: 756 - protein, 9 aa, Artificial Sequence
  Description of Artificial Sequence: Synthetic peptide
FDKLPRTSG

SEQ ID NO: 757 - protein, 7 aa, Artificial Sequence
  Description of Artificial Sequence: Synthetic peptide
FKLMVWY

SEQ ID NO: 758 - protein, 444 aa, Artificial Sequence
  Description of Artificial Sequence: Synthetic polypeptide
MAEPAGSPTSTEEGTPGSGTASSSPGSSTPSGATGSPGASPGTSSTGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 759 - protein, 444 aa, Artificial Sequence
  Description of Artificial Sequence: Synthetic polypeptide
MAEPAGSPTSTEEGASPGTSSTGSPGSSTPSGATGSPGSSTPSGATGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 760 - protein, 539 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 761 - protein, 683 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 762 - protein, 539 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 763 - protein, 971 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 764 - protein, 971 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 765 - protein, 971 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 766 - protein, 1020 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 767 - protein, 1231 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 768 - protein, 1259 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 769 - protein, 1270 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 770 - protein, 1259 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 771 - protein, 1270 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 772 - protein, 1308 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 773 - protein, 1319 aa, Artificial Sequence; identical to SEQ ID NO: 701
  Description of Artificial Sequence: Synthetic polypeptide

SEQ ID NO: 774 - protein, 541 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 775 - protein, 685 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 776 - protein, 541 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 777 - protein, 973 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 778 - protein, 973 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 779 - protein, 973 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 780 - protein, 1022 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGMAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 781 - protein, 1233 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 782 - protein, 1261 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 783 - protein, 1272 aa, Artificial Sequence
  Description of Artificial Sequence: Synthetic polypeptide
  MOD_RES (827)..(829): Any amino acid
  MOD_RES (840)..(843): Any amino acid
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 784 - protein, 1261 aa, Artificial Sequence
  Description of Artificial Sequence: Synthetic polypeptide
MAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 785 - protein, 1272 aa, Artificial Sequence; identical to SEQ ID NO: 699
  Description of Artificial Sequence: Synthetic polypeptide

SEQ ID NO: 786 - protein, 1306 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGVLQGHAVQETDDTSHQEAACHKIAPNLANFAFSIYHHLAHQSNTSNIFFSPVSIASAFAMLSLGAKGNTHTEILKGLGFNLTELAEAEIHKGFQHLLHTLNQPNHQLQLTTGNGLFINESAKLVDTFLEDVKNLYHSEAFSINFRDAEEAKKKINDYVEKGSHGKIVELVKVLDPNTVFALVNYISFKGKWEKPFEMKHTTERDFHVDEQTTVKVPMMNRLGMFDLHYCDKLASWVLLLDYVGNVTACFILPDLGKLQQLEDKLNNELLAKFLEKKYASSANLHLPKLSISETYDLKSVLGDVGITEVFSDRADLSGITKEQPLKVSKALHKAALTIDEKGTEAVGSTFLEAIPMSLPPDVEFNRPFLCILYDRNTKSPLFVGKVVNPTQA

SEQ ID NO: 787 - protein, 1321 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEGLQGHAVQETDVPRHDHEQHQEAACHRIAPNLADFAFSLYRQVARQSNTSNIFLSPVTIARAFAMLSLGTKGATHAEILEGLQFNLTEKAEAEIHEGFQHLLHTLNQPDNQLQLTTGNGLFIDEKAKLVPKFLEDVKNLYHSEAFSINFRDTEEAKKCINDYVEKGSQGKIVDLVDELDKDTVFALVNYIFFKGKWEKPFEVEQTTEEDFHVDEETTVKVPMMNRLGMFDLHHCDKLSSWVLLMDYVATATAFFILPDQGKLHQLEDMLTKEIRAKFLEKRYPSSANLHLPKLTISGTYDLKSLLGNLGITKVFSDEADLSGVTEEQPLKLSKALHRAVLTIDEKGTEATGATILEAIPMSIPPNVKFNKPFLFLIYDTKTKAVLFMGKVMNPTQ

SEQ ID NO: 788 - protein, 1260 aa, Artificial Sequence
  Description of Artificial Sequence: Synthetic polypeptide
GEDPQGDAAQKTDTPPHDQNHPTLNKITPSLAEFAFSLYRQLAHQSNSTNIFFSPVSIATAFAMLSLGTKADTHSEILEGLNFNLTEIPEAQVHEGFQELLRTLNKPDSQLQLTTGNGLFLNKSLKVVDKFLEDVKNLYHSEAFSVNFEDTEEAKKQINNYVEKGTQGKVVDLVKELDRDTVFALVNYIFFKGKWERPFEVEATEEEDFHVDQATTVKVPMMRRLGMFNIYHCEKLSSWVLLMKYLGNATAIFFLPDEGKLQHLENELTHDIITKFLENENRRSANLHLPKLAITGTYDLKTVLGHLGITKVFSNGADLSGVTEDAPLKLSKAVHKAVLTIDEKGTEAAGAMFLEAIPMSIPPEVKFNKPFVFLMIEQNTKSPLFIGKVVNPTQKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 789 - protein, 1269 aa, Artificial Sequence
  Description of Artificial Sequence: Synthetic polypeptide
  MOD_RES (824)..(826): Any amino acid
  MOD_RES (837)..(840): Any amino acid
GMPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQATTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDRGHVFRGHTHVYPPRGQVQQTLCLLNDGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 790 - protein, 1309 aa, Artificial Sequence
  Description of Artificial Sequence: Synthetic polypeptide
MAEPAGSPTSTEEGTPGSGTASSSPGSSTPSGATGSPGASPGTSSTGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 791 - protein, 1464 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 792 - protein, 1464 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 793 - protein, 1464 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 794 - protein, 1464 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 795 - protein, 1608 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 796 - protein, 1608 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 797 - protein, 1608 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 798 - protein, 1608 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 799 - protein, 1475 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 800 - protein, 1475 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 801 - protein, 1475 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 802 - protein, 1475 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 803 - protein, 1619 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 804 - protein, 1619 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 805 - protein, 1619 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 806 - protein, 1619 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 807 - protein, 1176 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 808 - protein, 1176 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 809 - protein, 1176 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 810 - protein, 1176 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 811 - protein, 1896 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGLTPRSLLVGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 812 - protein, 1032 aa, Artificial Sequence
  Description of Artificial Sequence: Synthetic polypeptide
MAEPAGSPTSTEEGTPGSGTASSSPGSSTPSGATGSPGASPGTSSTGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGKLTRVVGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 813 - protein, 1032 aa, Artificial Sequence
  Description of Artificial Sequence: Synthetic polypeptide
MAEPAGSPTSTEEGTPGSGTASSSPGSSTPSGATGSPGASPGTSSTGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGGLGPVSGVPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 814 - protein, 1032 aa, Artificial Sequence
  Description of Artificial Sequence: Synthetic polypeptide
MAEPAGSPTSTEEGTPGSGTASSSPGSSTPSGATGSPGASPGTSSTGSPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGAPLGLRLRGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 815 - protein, 1475 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGLTPRSLLVGGGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 816 - protein, 1271 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGGGKLTRVVGGGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 817 - protein, 1559 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGGLGPVSGVPGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 818 - protein, 1127 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGAPLGLRLRGGGEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQKGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 819 - protein, 11 aa, Artificial Sequence
  Description of Artificial Sequence: Synthetic peptide
ASTGETGETGE

SEQ ID NO: 820 - protein, 881 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSATASSSPGSSTPSGATGSSTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 821 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngctggctctccaacctccactgaggaaggt

SEQ ID NO: 822 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXAGSPTSTEE

SEQ ID NO: 823 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngaaagcgcaacccctgagtccggtccaggt

SEQ ID NO: 824 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXESATPESGP

SEQ ID NO: 825 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvnactccgtctggtgctaccggttccccaggt

SEQ ID NO: 826 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXTPSGATGSP

SEQ ID NO: 827 - protein, 6 aa, Artificial Sequence
  Description of Artificial Sequence: Synthetic peptide
GPEGPS

What is claimed is:

1. An isolated fusion protein comprising a recombinant alpha 1-antitrypsin and a first extended recombinant polypeptide (XTEN), wherein said fusion protein is selected from the group consisting of the fusion peptide comprising the amino acid sequence of SEQ ID NO: 699, the fusion peptide comprising the amino acid sequence of SEQ ID NO: 701, the fusion peptide comprising the amino acid sequence of SEQ ID NO: 703, and the fusion peptide comprising the amino acid sequence of SEQ ID NO: 705.

2. A pharmaceutical composition, comprising the isolated fusion protein of claim 1 and a pharmaceutically acceptable carrier.

3. The isolated fusion protein of claim 1, comprising the amino acid sequence of SEQ ID NO: 699.

4. The isolated fusion protein of claim 1, comprising the amino acid sequence of SEQ ID NO: 701.

5. The isolated fusion protein of claim 1, comprising the amino acid sequence of SEQ ID NO: 703.

6. The isolated fusion protein of claim 1, comprising the amino acid sequence of SEQ ID NO: 705.

* * * * *